United States Patent 11,583,558 (METHODS AND COMPOSITIONS FOR TREATMENT OF MICROBIOME-ASSOCIATED DISORDERS) - sequence listing, part 6

SEQ ID NO: 7 - DNA, 6037052 bp, Clostridium beijerinckii WBS-01 (residues 4,024,703-6,037,052 of 6,037,052)
tgattacttccacttttagccccatctaaatctactaaatgtatatattctgctcccatatcttgaaaagattttgctgtttcaaatacatcatctgcaacaatttcttttttattataatctccctgatacaatcttactggcttgccatcaattatatcaattgctggtaaaattatcatttaatcaactccccaaaattttttaaaatggccaaacctacagatccacttttttccggatgaaattgagctcctattacatttttgcacctaactacacctggtatcttattttccccatattcgctgtatgctaccaaatcttcatcattataaccttgtgcaaaataagaatgcacataataaacaaatcccccttcatctatacctctgaaaagttcatcgcttctactaaacaccaaatcattccaaccaatatgtgggatctttatattattaactttatcatctttcattttaataatactaccctttaataagccgagcccttttctttcaattccttcaaatccattttcaaataataattgcataccgagacatattccaagaagcggtttattcctttttacttcttctgatattattttgtctaaagataacttttcaatagtttccatagcatctgggaatgctccaacgcctggtaatattaatgcatcagcagctctgatttcatctttactacatgagatcttattctcaatctcaagataatccagggcattcttaacgctttttaagtttcccattccatagtctattataactatcattatataaccccctcctataataaagatcaaaatgaataacaaatgataagttagcatctctattccccaagctttacagatattttactaataatcagcattattcatttttctcttttataattttttataagcttcctttagtagatggtatatcattatcactacttctagatatagcttctttaattgctcttccaaaagctttaaataaagcttctattttatgatgatcattttcaccatataaaacttttaaatgaagtgttattccagcattaaatgcaaaggctctgaaaaactcaaccaccatttcagttgacatttcaccaactttttctctcttaaaatcacaatcaaaaaccaaaaaaggtctattgctcacatcaattgacgctaaagcaagcgtttcatccattggtacataaaaagttccatatctgtttatgccatgcttatctcctagtgattctttaaatgcttctcctaatgttattccgatatcttctattgtatgatgatcacatacataagaatctcctttagcaaacacatccaagttaaccttactattaaatgaaaacaaagttaacatgtggtctagaaatccaatccctgtatttatttcactattcccgtttccatctaagtcaatttctactctaacactagtttctttagttattctttctcttcttgagcttctatctgacatactaattctccttaaaacgaataatttaattgtattttaaatatagttttccaaaagaattctataaattaataatatctatataaaacataatctttctatagtcaagcatatctaagaaaataatatgcaaatgatataattattttttattgaatcaaatattatccctttaaataaatcaatataccaacttattattttcctaaacatgccaagtatttatacatatataaaaatcttttttattccttcaactactttcctattttgcattggtgaaccaactgtaattctgaaactgtcatcattaaaatttctaattattatcccaatactctcaagtcccttaataagagcttccttatgaggtgttcgtccaaagatgtagtttccctttgacggatagaattgtattttcattgcggcatttttttcaacctcttttaaattctcatataattcttctctttgtttaactatttgttttgcatttttaacaacattttctgggtatctcaaagccattgaggccagattttgcgaaaacgaacttattgtatatggaattttataatttaataattcagaaatattactctcatgagttatcaaaaatcctactctcaacgatgcaagcccccaagcctttgacaaggttcttgtaacaaccaagtttttatatttatttatatatggaatcattgattttccgtagaattcataataagcctcatctacaagaacaacagtatttttaaaaacttctaaaatattaactatatcttctaactctattccaattccagtaggattattgggatttgaaaagataattaaatctacggcttcttgttttcctatatttataaattcccgaacattaaaattcatagtttgccctatatcatatttctttaattctccaccaaatcttgaaacaaaaaaatcatacattgtaaaatctggtcctagagttaatgccttctttccatttttaatagccttacttacaacaagttcaagcatttcatcagacccatttcctacaattatatttttgctctctatatttgcataatttgcatataattctttaatggtagtcatctcatttgtaggatacctatggaaaagtacattagttaagcaagatttcattttcattagtatctttgtgtccatctctagataaatttcattgctatctagatttattgtatactcatcatacgaatttatatactcattatacgttcccattctctaatctcactttcacggaattagcatgagctgtaagtccttccttgcttgctaatgttataattttttctccattttccataagtgcttcttctgaataataaatgaaagaagatttttttataaaactatcaactgataacggtgaaaagaaccttgctgtaccacttgtaggtaatacatgatttgttcccccaaaataatctcctataggctctggacagtatcttcctaaaaatacagaccctgcatttctaaccatacctaaatatttcattggatcatctaccattagctctaaatgctctggagctatagaattagaaatgtcaatacattcttctattgttctacaaattattgcacttccaaaattttcaagggaagttcttattatttcttctctttcaagagtctttacttgtcgttccaactccatctcaactctcttgtgtaattcttttgatgttgtgattaatattgatgatgctaatttatcatgctctgcctgtgacattaaatctgctgctacaaaacacggattagatttctcatcagcaataactaatatttcacttggccctgcaatcatatctatatcaacttctccaaatactaatttctttgcagtagcaacaaatatatttcctggtccaacaattttatcaacctttttaatgctctctgttccataagccaaagctgcaacagcttgtgctcctccaactttatatattttattaattcctgctattcttgcagccactccaatatatggattaatccctccatttttgtctggtggagttaccataacaatttcatctactcctgctacttttgcaggtattacattcataagcactgatgatggataagcagcagttccacctggaacataaactccaactctttctaaaggcaatactctctgccctaggtatactcctttatcttttgtcattaaaaatccatttgatttttgtttttcgtgatactcttttatatttgctttagcttcttctaatgcttcaatgaactctttctccactttattaaaacattcatcaatttcaaaagttgatacttctaaagttttaagttcaaccttatcaaatgacttcgtaagttcaaataaagctttatccccatcttttttcactcttgatagaatactatttacacttgagattatctcttgttccgtttctgtaactctacctttaagttcactaattaagctttctttattactctcggtaatctccattaaatttaacatataattaatagcccccctttgacttgataaaaaagtaataacaacaaaaaatactctttaaattttatttattattttttgttaattactcaagatatcataatcaattttatcaacatctcacgaattttgtcaattattaatcactttcttaatcctatctataaaatcccatatttcattctgcttcattttaaaactagctttattcactatcaatctagcacttatctcacaaatcctatctataacaactaaaccattttcctttaaagttgttccggtttccatgatatccacaattccatcgcataggcctaatattggtgcaagttctactgatccctctatttttataacttctacatccatccctttctttttaaaataatcctttgcaacttttggatatttacttcctatttttatatgaccaacttttttgaaaatatcactttctggtaatgatgctactatgaatccacactttccaaatcccaaatccaaaacttcatagcaattgttatcactttccaaaatagtatcttttccaactactccaagatcagctaccccatgttcaacataagttattgaatctgctgcctttaccaaaaaataatttatatcctgcgttttatctttaaacacaagttttctacctttgctttttaattctgaaggatcaaatttcgccttatctaagatctttatggtttcttcttctaatcttccctttgttaatgctatgcttatgctcatttttaatattccccacccttaactacttttatttctttcatatcttcatttggtaataaatcaacgatatacccttgattcctaagctcttcactttttttaatagcttcaattctagtatttttattatagtatatcttatatatattttccttttcacttgctattttattgaactttacagttggaatcacagcatcaatatctatcgaaaatcctactgctggaacacatttttctgagagctcaattaaattatcatatcgcccacctctcagtaacgtattgccaacaccttcaccataacctctaaaaataattcctgtgtaataattcagtctcggaaccattcctaaatcaaatgtcacatttttaccatagcccaacaaatctagttcctggtataatgcctccagataatcaagattttttcttaactcttcattaaatgctaactttttagcctcttccaaaatctgtttatccccaaacatccaaggcaacttattaaaaaatgccttatactcttcctttatatctaaattctctaaataatcctccaaacttttcatgtttttatcttctataaactgcgcaatagcctctttatattcctgctctatttctaaatttttaaatgccccattaaaaaaaccgatatttcctatttcaagcttaaaatcatttaatcctaatttcttcaaagcttctaatgccaatactaatatttctaaatcagatttttcatcttcaagtcctataaattcaacaccgcaatctgtatattcattcctctttcctccaagacttgcgtgaactctaaaaacattcgaggtatacctaagctttattggtaattctacatctttgagcttagtctccacaactcttgctattggaattgtcatatctggcctcaaaattaatatacgacccctattatcgaagaacttgtacatatcttcttctcttaaagtttgtgaattatagttgaaagtttcataaaactccagcgtcggtgttataacttctttatatccccatttttcaaaaagtttatcaatgtctttttctaaaatacgttttactgcacattcatctaatactaaatcccttgttccttctggaagtatgttcttcttattcattttccaccccacctattcttattgcttaatctctatattgttttatcgttttatcagtttagcgtgctaaattatcatttaatttatgataacttattttttctaccatgtcaatcatttcaaaaacctttatatagttatttataagttatatgttaaatattcttatatccttaattttaactatatagaaattagtgttataatataatagtttatttgtaaaagtatttttaatactggaaatatattgaaaggggactttttacattgattactaaagatatacacttaaacgcaataaaaaaaatgcacatccataccaaaacttctgaatcagtacgtcttggtattctccttgcaattgttggaggtttcttagatgcttacacctttgtctgcagaggtgaagtttttgctaatgctcagactggtaaccttgttttacttggaatagctcttacgaagagaaatcctggccaagcaattacagctttactgcctattttagcattcgtgcttggggtgatatttaccgaaaggataaaagatattaaagttccatcaatgacttttgctacaaatgcggaacgtataattttaattattgaaattattgtgctttttattataggatttataccaactacagtccctaacatatttgtaacagttccaatttcatttgtgtcatcagttcaaatcgcatcttttggaaaactaattgactctccatatagtacagctatgtgcacaggtaatttgcgttccgcatctcaagctgcttataaagcatttatagaaaaagataaaaaacttgctttcaaaagtattcgctacttagttataatctttttctttattgttggagcttatttaggcggaatcttaactttacacgttggcggcaaatcaatttggttcgccgtagtaatattaattatttcagtaggcttatttagctttgataaatatatttttgatcataacaacaaagaacaaataacaagtgtaacttagaatgtcattaaaatatttaaattatataaaaaaatacctcaggtaaaataaacctgaggtatttttctaaaatgttacaacttcaatattttcaattgatttttgtactaattcatccacatttaatttttcttcttctttcattattgcatcaagttttggatttgtcttcggatgctttggaacaaatattgtacaacagtcttcataaggcaaaattgaagtctcatatgttcctatttttcttgctatttccattatatctgttttatccattgcaattaacggcctaaatgctggtctatcagcacaattatcacttacaataagaccatccatagtctgacttgcaacttggcctatactttctcccgtacttactgaatttattccatacttatctgcaagtctacatgctatcctcatcataaatcttctcattattattgtaagttcatcttctctacatttatttataatttccatttgaatatctgtaaaaggaactatgtacaaattaattttttctgtatattgagctaatattttcgctaaatctttaactttatcctttgctctttccgatgtatatgggtgactgtgataataaacacaacttacttcaacacctcttttagccatcatgtatcctgccactggggaatcaataccaccagataacattaacattgtactaccattcattccatacggaagacctgctgcgccctttgttatatcagtatttgcccaaacataagcataattatttcttatttcaatatttattaaaatatctggatttttaacatcaacatttatttctccatctaaattagtaagaacatatgctcctactttccttgaaacttccatagaattcaattcaaattttttattagctctatttgtaataatcttaaaagtatttccttctgattgtctaaccttttctaacgcaacctcttgtatactattaaaatctatgtcaacttctctaactaaacatacttcaagtatcccaaaaactttactgatcctattaatactttcttctatttcatcagtttttataaaatatcttccactatcgtgtataaattcagcttttatcccatcaagttttttagctatattatctcttaattttctttcaaatttacctctgtttaacccctttaaaaatatttctggtgcgtactttactaaaataagttctctcattatttttttatcctccttaaaaatttaagtcctttttctaaaatgtctactacataatctatctctgattcatcattatcatccgaaaaagaaaatctaattcctcctgatatttcatccttagttaatcctaaagattttaacacataactaccaccaattctctctctttccttagaagaacacgctgatcctgtagacacatatattcctgattcctctaaataatgaagcaatacttcgcctcttacacctctaaaagaaacattcaatatataaggtgaaaaatcattatttagtagactatttatctttatattatcgatattacttaatttatcaacgaattttttctttatttgaaataccttttcgtaattttttttcatattatcatttgaaatcttagaagctaaagccattcccataattccagatatattttgtgtacccgctcttattccaaactcttgagatccaccttctatcaacggtgataaagaactagtattttttatatatataaatcctacacctttaggtccatgaaatttatgagcactcactgttagaaaatctatattcattttctttacgtctataggtaatttaccatagctttgaactgcatcaacatgaaatttagttctattgctacttgctcttattatgtctcctatttcttttagatcttggattactccaacttcattatttacatgcattattgaaaccaatacagtttccttagttatagctttttttagctgttctaagttaatcttaccatcttcatttatctctaaaaatgttactttaatattattttcttctaatttctttatagtattcaaaatagaagcatgttcaaaaggagttgtaataagatgagttccgcttttcaaaagcccctttagaactaaattatttccttcacttccacccgaagtaaaatgtatttcattttcacttgcgtttatagttttagctaatatacctctgcattctttaagttttctttcacttttcaaccccaaattatgtaaggaagacggatttccgtaaaattccttcataccaaaactcacttcatctattacctcatcaagcggctttgttgttgaactattatcaaaataaacttccatataagtcttcttcctttcaagtttataaacgtctaaagatcaattataaaatatattcttcccttattatcttataaacttactatgtaatatacatgttttattataacaaaaaaataatccctgcatagtatttttttaaatatataaaatgaagcagtaaataagaatttcttacttactgcttctgatagagagagaaaattaataaggaataatttcttagtattaatttttgctatacttttcgtaatatttaataagaccttgagttcctagatcacccaaattatcgttatctaatgttttatacatttttagcacttcatttaatacgcctaaatttatggaattatccgtagactcttctattgctaaattcatatccttaataaaatgttttatataaaaaccagggtcaaaatctccttttaacatacgaggagccatatttttcatttgccaacttcccgctgcaccttcacttatactatcaagcatggtctgaacatctaatcctactccttttgcatacgtaattgcttcgcacactccagctatcgcaccagctaaagctatctgatttgccattttagtatgctgtccattcccagcttttccttcataaattatattggttccaagtgcagataaaacatctttgtgtttttcaaaaacttctaaatctccaccaaccattatagataatgtagcattctttgcacctacatctcctcctgatactggcgcatccaaagcatatatttctctctttttagcctcattataaatttttatagaaagcttcggacttgtagtagtcatgtcaattatacaagactcttttttagcattctctaaaatgccattttccccaaaataaacttcttctacatctttaggatatcctacaattgttattatgacatctctattatttgcacaacttttaacatcgtcgcaccatttagcaccttcatttataacatcaagaactttttcttttgtccttgtataaatagatacctcatatcctttcttcattaggtttctaaccatagattttcccattacacctacacctataaatccaattgtcttcacttcaaactcctccatttttagttataatattttgtatcctcatatttaacttcttaaaattagtattaagaatctttttctacgtcaatccatgtcattttactttttaatctattaatttctgcttcctgatcttttattattgttttataataaacttctttatctccccactctttacttaaattgtttattaatgatgccatttcgtcagcacttcctacaattctattaaagagcattaagttggacttaagtatttccggaatttcattatgggaatatcttaacctatgatctatttccccatatccttcctcaaaaattgttctaacctgtatctccgctattaccttttcattgattggataaaattcaactaaataatgaactgatcgatatccagaggcttttgaccttacttctataataggatcatcaaaaacatctatattatctccttctcttacatttgcagtaatctcagttacattccaagtttttattataaaatcatgtatcccctgccattggtctttaaatatatgtataactctaattcctattaaatcatttatttcatttctataattatttactgtaaattcaaaatcatctccgtatttattttttctatcttctgtctttcttataactttttctattaatctctcaggatctttaatccttgatttaacagaatgcaccattctctgcgatcgtaaaatgtttgctataaatgcagcctggctttcataagaagttttataatttatgtagtcttcgtagatttccttaagattttcaatattaatattatttttagaaattatttctttagcctgaggatatttttccaaaaatatatctatgttaaaactttttttcattctgcatactcctctataaattccattaatttcgatactatatagattatactacattaggcataatcaaaaaataacaaatccatctgccacatctattttccatcatgctgcatcagcagattgccctactagcttgctatgatcccactctactttcttgcctgatgaaaaataatcatagcattttgaccttgttattctctttcatatgccttaattaaaaattatttcaaaaaacttcaaccaaaataagattgaagttttttattaaaattatatggtttataataactaatagtttagattaaatttctatgaaatagtccttttcaaggtatataaatgtaaattgtttattatagcccaaatttttatatgcaaaatacttgtaaagaatatgctatccagcttctaatttaattcttagcaaatttttcagttctatttcttgtctataaattttgatattatcattgtacagacagtatttcctgatgaatttaataatgtcgctggtgcatcaattattgtagctattacaagcattatagctaatgcttcctgtggaaatccaaatatacttaaaatgagcatttcaccaatcgccccacctcctggcaccgccccaactactgcaccaatgagaagccctgctcctaatataggaaataaggaactaatagtatttatgtctctgccaaatatagcaaacaagaacattattttatatattcccccaatcaccgaaccatccttatgaatgttaactccaagaggcattattatattagccaaggtatctgatacccccatatttttagctgcttttatatttactggtatgcaggcagcactagagcatgttgctaatgcagttattgaaggttctgctgcatttttccaaaacaatttcacgccttcttttctacttgctatataagcatatatactgaagaatacaaagaagtatattatggagacaaccaagtatagtataaatatttttgcatacccacttaatatttgtcctcctaattgtccaattacatttgcaaaataagctccaagtccaattggtgcataatacataattatatttacaactttcattgtcactgtagctccactgcttaaaaatgacgcaaaagccttgccttgttccttagaaatcatagttccaaaacctattaatatagaaaataatattagtgctaacaaattatttctggataaaagttcagaaaaatcccctacacttatactcgaaacaatcttttctaaaactcctacacttttaggtgtatctatactattagtggtcattagattattaaacattgatggatccaacccaactgctggattaaacattttgaaactaattactcctattatgcctgaaataattgcagtaattccaaatgtaatcaatgttattataaatattcttccgagcctttttgatttatccatattagctatcgcggaagcaatactaaagaatactataggaactaacattgtaaatattaaattcaaaaataaatttcctagtggagcaaatattttagctttatctcccatgataatacctatcgccccgcctaataatatcgataacactagaatcaatgacgatttatagttctttaaaaatctcaattttctcacccctaaattttgatgcttaaattataaatactagcactatccaagagctttcctaacaatttccctatcatcaaaatatattttatctttacctattatctgataatcttcatgcccttttcctgctattattaataaatcatcgtctttcaaaagttttaatcctttttcaatagctttctttctatcaacaattttctcataagttgaatttatgacttccattccttcttcaatgtcttcaattatttttatcggatcttctgtccttggattatctgatgttattatgcaataatctgataaaattcctgccgccattcccattacttttctcttactcttatctctatctccaccacaaccaaatacagtaataagtttgcctttagtcgtctctcttgccatcattaatagtctttctagcgcatccggagtgtgtgcgtaatcaactattatatttttatttaaattattttttatcatttctagtcttcccggaacatgtcttagattagataaacagcttataatgtcacccatatccatgccaagacctatacaagctcctatagcagccaaaacattatatacggttatttttccaggaatatttacttttacatctgtaatacaccaccagcgccattttatgtccctaaatttgattttgaatattatacaatcatttctatatctaatctcagttgctctaatatcagcctctttatttattccataagttaaaatcttgcaactagccttttgtataatttcttctgctattccatcatctagatttataactcctagctcacattttttaaacaattttatcttttcattcttataattctccattgttccatgttcttcaagatgatcttgagatagatttgtaaatactccaactttaaaatcacaatactcaactctctgttttgctaatgcagacgaagtgacttccattacaatattttcagcacctttattaataaattccctaaataatccttgtaattctaatgattcaggtgttgtaggattaaccttttgtatgcttgctttttctttattaaattcatatcccaaagttcctattatagctgttctttttttatatgactccaatatgtcttttatataatgtataactgtagtctttccgttggtacctgttactccaaccaaattaatttctttagaaggttcattataaaacacgttagctatacttgctaaagctaacttagtatttcttacttttattactgttatattttcattatctattttaatttcttcctgtatcactattgctaaagcgccactttttattgcttcatctatatagtcgtgaccatctgcattagccccctttatgcagataaacactgaacctcctttcacttttctagaatcataactaacactcctagcatctatatcaacactgccgctaattatttcgtaatctaaatcttttaataaattgtataacttcatttttattcctccaagaattacttaacttcttatatcttcattatatacaacattttcgcattaaatagtgcatatattgcttgatatactgcaaaaagtgctttatgattttaatatatatgttgcaattgaatttttacattattattataattgtgcacttagcttactggaattttaaatgtaagtttattattactacatatataaaactaagatttatatatacacttcttagagttaattgaatatatatttatatcttatatttttaattaatacatttgtaattaaagttattttaagggagttttcaactatgaataaaaatagtaataaatcaggctacttaaacaatgattttcaattatttcatttaaaagataaaaaaaatcaagaatttgagttccattatcacgactttaataaaataataatttttttatctggaaaagtaacttatttaattgaaggaaaagcatacaacttaaaaccatgggatattctacttgtaaataatcatgatgttcataaacctattattgattcttctgaaatttatgaaagaattattatctgggcgaattctgattttatagaaaaccataactatgaaaattgtgatttatctacttgttttagactagcgaatgaaaaaagtttcaatcttattagacttaatagtaaattacaagataacattaagtttataatagattcactaatgacttcctttaactcacaagattttggtagtaaacttttgagcaattcattatttattcaattgcttgtatacttaaatagagtgcatcttaacaacatgtacattaatgatgaagcatctctcaaatatgataagcaaattgaaaaaatcttgaaatatataaataataatttatctgagaatctttctacagaaactttatctcaaaagttttatattagtaaatattatcttatgcataagtttaaaaaagagactggatatactcttcataactatgtaaatcaaaagagattactaatggcaaaggaccttataagtagtggtgatcaaattacgaaagtttatttactatgtggatttaatgattatacatgttttctacgttcatttaaaaatctgtttaagaaatctccaagtgagttttcacttaaaacaaaaaaatcgcaggcaactgttgagccgtagattttttacgcatctgccttttcgaacgtatgtgagaaaaatttggcaggcgaatatattttcttttttattctccttacaaaccataactttctgaatcagtcttttctataatctatccacagatttaacttgaatataaattcctagagaataaaaaaactatcttaaaaatagttctctattctaagatagtttttaacaagctgccggtattaatatagtagctcattaatatttaatattagttaaacttaatatggcagtaaccagtaggatttttttctaaataatcttggtgatattcttctgctgtatagtatttttttaacggtttaacctcagttacaacttgcgcataacattgttcctgaattttcgctttacttatattaattgtatcagcatcagattcatcaatataataaattccacttctatattgagtaccaacatctccagcttgtttatttaatgtcgtaggatcgatgatactccaaaacttatctaataattcatcaagcgaaacttttttttcatcgtatgttatgtagcatacctcaacaaagtctgtatcatttttgcaaacttcttcatatgttggattttctgtttttccatttgcatatcctacttctgtttctaatactcctggtatcatagaaaagaatttctctacaccccagaagcagcctccgccaaaaactatttttttcatatttaacacatcctttaacagcattataaacccaaataatagtactttgcaattatatatattataattgagtttctaaatttttatcttaattgagagcttgacttagtacaaaaataaatatagatttatcattgtaacaaacctgtaaagtgaaatgatgtgccttataaaatcaagttttcttttcactattaactctatccatccaatttaaaatatccttatatacctgtaatttatttacttcgtgtaaaagatcatgatatttgtctgaatatattttagtaaagattttctcgtatcctattttttttataaaccgtgttaattcattaaatctttttatacttataataactatatcatcttctcctgcaatcgatagaatcgggagatttaagtttctttttgcccagtcttttttgctatagtcaatttttattaagttacatagattttcaaaaccatttattgtgaaaataaatccacaaccttcatcattcgtaaacttatctctttctatttctgaggttgttataacattatcgcctattcctcgaattattttatgtataaaaattgatctataatgatctccctttatcttttctataattttacacaattttttaatatacggtataactttattctttactggtgaaccacaaagtataagaccatctaactcataatcatatttttttaagtatgctcttgcaattaatgatcccatactaaatccaaataaaaagtaaggatatttcttgtacccttgcttcatatatagtgttatctgatgtaaatcctctacgagatttgtggttccgttgttataaaaatatccataatcatttttagtaataacactttcaccatgacctatgtgatcatggactatagaaatataaccattgctgcctaaataatccatgaactgtatatagcgttttctatgctccatcataccatgactaatttgaaatattccctttatttcgcccttaggtacataaagcgttatacctagatttatattgtcttgcatagatttcatcttaaaatccttaaattttttagaataatcttccacttcattttcataagataatttattcataaattcctctttattaaaaagcttatttttttatatacttcccttatttatagaaatttaaaatacttatgaaagaaatctataaaactccaatgtcttgctttatgtttcttacaaaacaaaatacccaaaagctcatttaagattctttcaggcattttaaatttcctaatttaatataataaatttttattataaattctcatatactgccttatcatataagtaaataattgcgaataaataatcctttaaacttataatcgctttacaaaaaacactaacttcaatatctatatatacaaaagccatgatactatattatcatttttctgttcactaacactctctccaactgtttagataacaatttaatctcgctagtaagctcactaatttctttttccttttcttttattttagtatccttaagctttaattgctcttttagtaattttaattctttattaaaaccttcaatataattatgagaaatagcttgtaattgagaacgtgagattcctatttctaaatcgttgtatacattatgtttaagctcactaaatatcttatccctgttgccatactctatatatgatattaatttctcattaatttctctatttccatttagaactctaaaaaatacattagttattatatttaatatctctattccagagccataaattttattattcttatcagatacaataaatgtattaattttactctgaacattatcttgcatacttaaattaatatttctattgttatatatatcaaagaaattttgcattatactacaatttctatttcctacttttgcttcaataactatcccacctgattctccatcattcttagtaataaatgaatagaacttctttaaaagtctttttgtcactattgaatacgaatcatctgattcatttaaattttgcttaattgagcttgaaattattttaaatcttaatctgctaatcaatgttggtaatttatttacaaactcacttattataattttatcaatattcttgtatacttcctcttttaatattatattatccattggtatatttgcatcactatccagaagacattctttcttatactcatttaattttcttttcaattcacattcactgtttttccaatagatgcaataatcatattcaaaaatcaaccctaccattgagaaatttccgcttttatctaaacttctaattcccctttcatcaataaacattacatattttttccccatataaacttctccccttcactaattactctttaacctaatatacccaatattctttacaacgcacaacaacagatacatccttataactatcctaagcatgcttttttacatataatttattaaacatcatcgtactaatgcgattttttaaaggaaatatattttttattaccctactactcaaaattaaattctcctctattttttgatacgtcgaaatagcaaatacaatcacaaaataagtttaaatttatcttgcaattgtatccgttaatactaaataaatatatggcatacttctatagatttagaacttagattactaaatttatgaaaaatatttttctagtattctagagctcttaaaatatttatagagacaggataatttactcgttaaaattatcctgtctctatagaaaatatatcagtttagattactgtctatttatttttgtcatttcccttacctttggaatctgaattgccattattacttttctctgactttgatgagttgctatttccctgagttccagcaccctttttttcggatccatttgaagccttttcatatttcctgtctttgtcttcttcttgattaatgtctgcattactattttcttcttttttcaaattaccattattacttttctcattccatgaattattgcctttttctgtcttagcttctttagttttttgatctcctattgatgattgtgtaaatgtaatatcttcttctgttgatccagacgctacattagcatcctgattactagtgcttgtgtttgtatctgttccagtgttagtatttgtattactatctgtaacattcgtattagtatctacagaattctttacatcaacagcatcattatcatttctagtcatttttctcaattctttagttttcttttgaatttccttaaccgaaatcgatttataatcgtctaccttaatacttggatctagtgcttgaagcttttgtataagatttaattttcctggagttattccgagttgccttgcttcatctcttcttgcaagtgctactttatcagtttcaacttctgcttccaaatcattattttttaatgtttcatctgcagtttcttttaaagattcatttaacttatctgctaaaccatccttatctgtagatactgtaatttcaactgctgcagctgtagttacatttgtactatcttcctttatgtaaccatctgatatggcatttgttattactgtgctgactgcattgtcaactttagtgtttaccagattagttccttctagaactttttcaccatcttcattatatgcttctgcagataccactgtatcaaaagcgtttactcctagctcaacactcggattaatatctaaactgacatatgctactggagttttagcataagcatatactcctcctcctaaactaaatgctactgctatcgatgcagctaaagcaatttttctcttcatataagttccccctaaaatattttttatcttattgttaaatgtatttttcttgcttaagtatcccgcttttttctttacagattcttcaatacgttgtctagaagacaagtccatagataggttaatattttcattcaataataaatcagtatcactaatgtttaagtcatctaataattcaaataatttatcatccaatttatctcccacctcccaatattttttttaatttttccatacacctagaaacttttttatcaattgtattaacttttaaacacagatcactggaaatgtcttttgaactttgatgtaagtaatattttcttataattatttcactatcaggttctcctaatgattttatagcatttataagctcagaattgctttcttttaataaaatcgaattcgccgcatcatctacaacactatgtaattcttgggccacatcatctattggaagatgattattatttttattttttctatacatatctatagcctttctttttgctataattgctaaaaaggctttgattgatcccttatctaaatcaattctatttttataatgaaatacttcaaaaaacacatcacttacacattcttctatatcttcttttgaatacattccagaaagtttattaaatattattgtgtaaataagtgccatatagttatccatcagctttttaaggcctatttccggcttctcatccaaaagttttagtaattcaatatccgaaatcaaaacgcaccttcttcccctaaaatttcgttatatattatacaattcgtaatacataaataaaatctgacaacaaatttcaaaaaatataataatttttacattatcaatatcaaatacttatattttcttttctctcctgttctatgtaatatatatcaaatatatagataaatcctattaatgctattactagtgattcttcaataataaccttttatattatttcacgatatattccaattaaatttatacattctgttcctacactggatctaatgaagctctaaatttaaattggttatcgcaaaaaaatgagtagctattattattttctatattagctactcattttaaactatttaattatttttatttttatccttattaccattctgcgagtttgaattaccgttatcactttgtttttgagttttagctgaattatcttttgatttttcaactgctgtggcattttcttctcttttactagatgagtcactattttcttctttcttaacacttccatttccatttgatttagaagaagaattgcttattttatcttctgtaactgcatcttgattagcaccactctctatgtttccaccagtatttgcatcatctttaactgtagtctcttcattattattgatcttctttaattctttagtcttcttttgtatatcttttacagaacttgatttataatcttctacacttatagttggatctaattcctgtagtttttgtatcaagtttagtttacctggagttattcctaacgttcttgcttcatctcttcttgcaagagcaacattctgagtttcaactgttgcttctatgttattttcctctaatgatttgtcggcaatttgttttaaagattcatctaacttcgttgccacattatctttatccgtagctgtagtaatttcaactgccgatgtaccgtcttcctttatatatccatccgaaactgcctttgtaataatattcttaactgcatcatcaacatcgctatttactaggttagtatcttccaacacctttttaccatcttcattatatgcttctgcagaaataacttgatcaaatgtatttactgataattcaatacttggattaatatctacactaacatatgctacaggagtggtctttgcatgagcatatacacctccccctaaacttgaaagcgctacaacagatagtactaaagctatttttcttttcatataaattccccctaaaatataattcattttttctttaaaagtattatttgatttataataaccagttttttggccaactaatttttcaattctttttatagtaatatcatctaatgataactttatatctttatatagcaacagattagtatcactaatatttaaatcatccaatttttcaactagtttattctccaaattataaaatccctcccaatagttatttttttgtgcacaaactaactatttttttctttactcttcttaataattttaaaaccctggttttaataaatactgtaaaacttctatcagttgttttttgcttttcataatataattcgtattgttattatgaaatctgacaataccgctgatagaatttaaataaatttaattaagaaaaaagagccctatttatttggctcttttcttacaggtttatattttgaatttggatcatttggatttatgtaatcataatctccattttcagtctttcttaatcctaatgatgccatttgctttttagtgactttacgtttattagtcataattatctctccttacacttctttagatttagctcatattaaaaatttgtatcagtaatctacataatgatatgtaaatattatttctaaataacatataaactaacgtggttaaatattatcatcattaatctatattatataaggtatatagatctaaaatcttcttttgtaatatcttatgtacttatatctaaatttctattttgcatattattcttgactttagtatacgcactcattctaagtttatactaatttatgattcatcttattatgttaagctgctcataaaactacttaaggcagctccataatactgtgaagcataaatctcctactaatcttaagacttctttaaatgaatcagtcttctcgtgatttatacccgcaacgaatcaactcaatgtccaccaatttggcttcatatagataactaaggaataaaaaaaacaaactcagaaatatttgtaacttctaagtctgcatctcttaataatttaatataagttttagttcataacaataatgaaatctagacgataaaattctcatccttaatttgatatatgttgggagaaagatctatctatataatttctacttttatttaggaatttactctctatttccttatcccaaaacttcatagctggttttccgataaaattaattcttgcaccttcaataaccatgcatatgaaaaacacaagagaaatagtaattatagcatgaagcgacaaccatcttgaattgtaaaaggaattatttttagcaatatgttcccataagtaactccgaacaagattattatcatgaatcaaatatattccaaatgtagttgaagatatactattaattatctttttagatccaatatctaattttttaaaataaagaaataatgaaattgagcaaataagcattggtagggaattcatctctcttaagaatgtaggatcaataggaaaatcatttattcttagagataacacatctagtataactaccgagaacattattaagatatagctgctagtgaatatcactaaaagtaatttcgtcttatcaaaaaacttatgttgatatttccttatataacttgcaactaaatacaaaaatacaaaccaagataaattatcaatttcaagtaatgaatttgaaaaagtaggtatgactgataacactacaatcagtatggtaatcaatatcttattctctttttgagtacaataattgataagcttatttaaatatggggatagtatatataattccacatatgtagtagcaaaccaatacttagaaaatattatagggaaaaatgattcagcagtttctctaattcctatatgagatattccgaataatttaaaaatcagcattataactacagaataaaagaaaacttgtcctacaattttagcaaacttttttatattaaattttgaattaatcataaagtatcctgtaattaaaacaaagcaattaacacctaatttcccacctaaacttaaaaattggacaattatcctgttgtaacttagttcgttaggaatatcccatccaccatgaacagaataatgatgtgcaataatcattattatcgctaaaattcttagtaactccaaattagagcttcttcctatttttctttcaaacatattaatcttcgagtcaatttctgtattttccaccgcatacacctcatgtcaataaaactaacttaatagtcttatacttaaactttctattatcactggtaaattatatcataatttactgttataatagcatttattttcaacttatatttttactgaatattaactatatcacgcctaatgactatatatagttaatattctaaaatttttaagaatatttcaacattctttaaatttttattaatagaaatcactttattatcttacaaaatacatccccaagctatcccctatacatttctaatggggtctatctatttggaactaattctccttttttttatttatatgtttttagcttattgatattacgcaaaaaattggaaactcaactttaagtaatctatacttctcatcctctaataatatcgactacaactatattcattatggcaacgtaattactaatcaatcttaccagatacatttactttatattcattaattcctagtattcatattaatcttctaacatatttctgttatatattttatctaaattctaataataaaatttgagcggttcaatattcgaatttaaattatgaaaggtggctaaataatgaaaaaatttacttttatactttctattattttactaatcacatttaatattaataaaacgactgccactgctgcatctctccctcaaaacttttcagaaggattctacactatatcagatttaagtatcatgcaaaatgttatgtataatgttcagaacctttctcctaacgaagtttttatgattattttcgatagtaataaaagaattcaacaatctataaggttcgaaggacattcaatgaaatatgtaatgcgtcctatgaaatatgattataaaattataataattggtgatggcagcatatcattttcaccaatcaatataaatggcagataaatactctttataattacaaatgtatatacaagctcctcctttataggagcttgtctgaaatttaagcatttttctactgatcatgaacaaggaggtatacgccacgcttagttatatcattttgaaatttccacattacttaattcctttaaataatccaattttataacctaacatctttataattccatacaacaataaggctatttttattttatatttttgaagactttgcctttatcagtgatcctgtaacacaaaaaagagccttaattataagactcttaattctacattactattaaacccataattcatgactttctctttttagtgaatattgacattttcccaatagtttagagcttaactcactcttagcatttctatgaatatgctcataagcatcatatacatagagaatgtccaaatctaaatctttagtatgtttgtttaaagtactttctgcatataaaaagtgcttttgtaaagatggttgaactatccacctagatttttcttctcctaatttaatagatttatcattattctcaatcattgatttcatatcttttaaacacataaatttaaatttttctgtaggaattctattgattataagataattttctaatctcttataaagatttttttcaacagaaatgtagatattttctttacttcttattccttcttctatgtagttatataaattaacaattaaatgctgctctccatagtagtataaaatagaatctctttcaccagtatttcttcgattggaactatataaattgcttgtgttgcaaaatatacagtcagatattaaatcatcaatagattgacttaagcaaattacttcatcatccaataagttattttgcttttttgctagcaaatcatcaagcctttccttccattccttaatatgacactttaaaccacaattattacataatactctcattatctcaccccatttttattttaaaacccttttacaataaaattataacatctttctatgtaaatttatgtcattacttgtaagctgaaaaaataattgtattttttgtagtttaaacataccggaattttctaaactcttcgatgtttttgtattttctttaattcatctcgaaataaataattatagggtttatactgaattgtttttttatttcaggcattcatatattcccctctttatgctataataaaatcaaataagttagagttcaaactttccactttgctttctctaattattgataggcactcataacgagtgccttttatttacatttgcaaaaattttaacatatgaatcataagaaaacgaagtttgttttttcattaaaaaatatatgatatttacttctatataattttagtaatcactttttagtagtttcttaattcccaaattattatattttcttggtttattccaaccggtatttcaaacagagagaactcaaccaccatgtcaattaaagaattttgtgatatataatctataactttagataatccacttattggcggatctcttttttcttttagatcgtaattataaatattatatactggcttttccattgcaattctatttgatattccttttatatcacttaacgatgctctcataataaaatctctgtctatctctatgtcaccttgtaatattaatctatcatctgcaatagctaaactctcatatactgcatatctcttgtattttttgctttttagcaacacctgatctttggtaagcatatataaaaacttacctcctgatacagatttatctcttatattataatatttataggtattctcttctaaataacttttaagttcatctaaagtcgaattatccgtaaatatattttctgacattctatttaatccaagctttttaatcatataatcactttcatatttatttctaatcatgaaatcactccattttaattttgtgtaataaaaaacacacctccatttctgaataatgtgctatttctaatctttatagttactataaaaccttccttgttgcatatagaacttgtctctactgactttaatttattctagcatatttttgaacagattttatattttattgatattttttaaatttatataattaaaataggaaggtttcccttcctattccattcctataaattcaactttttcaacatttcttatgttaagcaaaccctctgtcaatgtttttatatctccatctactgtagacaaatctatggttatactcaaattagcataaccatttaacggtatgccttgatttattgttaaaatgtctccgcctttttctgtaatataattacttatattcgataaaagccctttttcattcttaaatataatattataggtaacttttctaccctctgaagtttctgcaaaatcaaatacgaaatctctatatttataataaacacttctacttattcctgctatttttactgcttcagttatttcttttacttttccatcttttaataatttttttgcaaaaagaactttttcataaacatcaggcaaaacccttttatctataactaagtaatctccactcatcattttgtaccttctataatggttgcccccgcattatctaaagataaccctaatatattccattccaatccttttatttgcaagaattctttaagcttattgctaaagcgctcatccttttcatcgataatcgccatgattgtaggacctgctccacttagatagcaagctagagctcctaattcataactcttattatacacctcttcaaaaccaggaattaatttactcctgtaattttggtgaaaggcatctttacatgcataccttaataattcatattttccgctagaaaaacatgcaaccataagagctgctcttgatacattatatactccatcctttaaacttatttccttcggaagcacttttcttgcttcctcagttgataatctaaaattaggaattatcgaaataaacttaattccattttttacatctatcttatcataataggtcttgttttcatcaaatattgcaacaaccatgcccccaagtaaggctggtgcaacattgtctggatgcccttcaatttctacagccatctccaacaactcttcttctgaaaacttcttccccaagatttcgttagctcctactagtccccaactatacatgtagagctacttccaagacctctagatactggaacatcttgtttaatttcacttatttctaatccttttattttatagcccgctttatcaaaacaatatttcattgctttgtaaataatattatcttcattacaaaactcttctggcattccattaaacttcaaaccatcttctatttccctgaacccaaaatcattgtataaatttaatgctattccaagcgtgtcaaatccaggtcccatatttgctgatgtagctggtactctaactgtaatcatatatttatcacctatgaatccaaataagataatagagcatttctcatttcactcttatcccaaacttcatcatgtattacttttgcattttccaaagtacttaaactatttggtattttattatttgttgaatcagataatttatttaatactttgaaatcatctaatccctctacatcaatatcaagtgcattacaaatacttcttgggaatttaaacggacttgctgttgaaagtattaaagttggtttgtcgtctttagtttcttctatatacttctttttaactacatatgccactgctgtatgagtatccatcaagtaattatctttcttataaacttcctttatagcatcatacacttcttctgtagtcgcaaagtttccataaaattcttttatgaagcttttaattttttcgtttacttcataaacacctttagtagttagatcttccattaatttgctaacaacttcagtatctctaccgcttgcttcaaataataatctttcaagattagatgaaacaagtatatccatagacggtgattctgttaaaataagttctcttttcttgtcatataccccagtttcaaagaaatctgtaagaactttattttcatttgatgcacatataaatttatctattggtaatcccatttgcttagcataatatcctgctaatatgtttccaaaatttcctgtaggaactacaacatttataggatcatctttttgtattactccttggttcactaaattaaaatatccataaaaataatacactatttgaggtactaatcttccaatattaatggagtttgccgatgataagataaatcctttttgagatagcccttctctgaattcattatctccgaagatttcttttacgcctgtctgagcatcatcgaaattcccctttattccaatgaccttaacattgtttccttcttgacttgacatttgtctttcctgaattgcactaacaccattcttaggataataaactacaactttaaaaccatcaatatttttaaaaccttcaagtgcagcttttcctgtatctcctgaagttgctgtaagaattgttatatcctctttaacatcacaaatctttttagctcttttcatgatttgtggtaaaaataataacgctgcatccttaaatgcacaagttggtccatgatataattctaaaaaattgttctttacttccacactaaatctatcattatatgcgtcattaattgccccagttaattccgcatcatcaatatctgtgaaaaactcattgataactttaaatgctagatcttcatatttaatatgcgtatcttccttcaattcatcatagactttaggaaattcatctggaacatacaatccgccatcttttgaaattccattaattattgctctagcagattctatattcttatccagacccctagtacttctaaacttcatctaatatcacctcaaaattgtattaaatatgaaaatatatctttattaattaacaaatttaagtatatataaacatattccacctgtaatatatattatcatgtattctatagataaacaagtgtttttccataaaacacatgaaaatcataatatttttttacatgtaaatgtttaatggcattatttggattgcgcaatcattaattcttaaatctgggcactctggtacaaaaatattatttttctctaaacactctataagaggagtaaattgctcaaaaaacttttcataaaactgttcttggccagtttttctaagtaaacttatagaatcttgttcttcagtgcacgtttttattacttttcctatgaccctacacggacaatttatattatcaaatatattaaatttattattcatgaaattatctttattgacgtttagtattattgttccatttccacatttcataattaaatctgtagtgttattattttctaaaatacttttcatataagtcagcatttttaagcacattgaaaaatttattttcacattacattctttagttagatcatccaagtattccgctccaaatattgttatcaaattaattagagtttcaatataagacataatgcttttatttgtaattgttccttcaatctcaattagatctcctggatatatattattattttctatatctttttcatttttatgctgcaactgtttattttcattaaagtagttaattaaacttccatttaatacgaatgtagtataagtagttttaacttgtctttcctctcttacacattgccttgcatctatttctttatcaatatgatgatgctcaaaattattattagcatctaattcatttttatccttaaatccttttctctcaattcttgtaacacttccttgattagaattttctattctatctccctcatgaaaccctgctgataatgttctatcaaaagcttgagttctagttattgtttctatgaatccagttaacactaaagaggataaatttctaactaaaatttcatctaaataaacaagtataccaaaaggattgctcatatatactcctttcaaaaaggttaatatctattcgtttcttcttatatattattcatattcatactaatataaaatattatttatacttttatttttattaaaaatgcatctattttttcccaataaattgcaaatttcttaatttgcgaattatttgaatcttttgtaatataaatttatagtataaatttatattaatatagaaattctaatatagtctttaggtgtacttaaacgcttgttttctatacacattttttagattgcctatattagtattttaatattataaaatcttttcagaaaggagatatgcctaaattattataaatacccgaataaattttattgattattaggcatgtggtatttaatgaagaagttttttaaaaggtttttcttaattttatttattgtactttttgtttttagtttgtttttttacaaaagaattatgttatcgtatagaatcgctgataagtatatttctttaaaaaatcatgtatggacaatacaggaattcaatactcaaaagtcatcaagttcaatgaattacaaagatgttatttataaaaatactaatggtgtcccattaaaactagatatttacggtccaataaatcaagtatataaatcttcaccagtacttgtatatgttcatggtggaagctgggcttatggagataaaaatattcctgatgcattgagtccagtactcgatacttttagagaacaaggttatacaattataagtacttcctatgagcttatgaaagaaaaggaaaatttcaacaaacaaatttccgatgtcaaggatacaataagatggataaataagaatcagtattcctataatcttaatacaagtgaaataggcattattggtgtttcatccggcgcgcatctttctctcatggcaagttacagtggtgatgatgaatttatagatgataacgaattaagcaattattcttcaaaagtaaaatacttaattgattttgcaggaccaactgatttaagtctattaaatactcaaaatttaaattatgatttatcaaaaatttttgcttctatttcaaataaagaagatgtaataaaaaaatataatcccataacttacgtcaacaaagcaactccaaatactttgataattcatagcaattcagataatatggttccttatgaaagttcaaaggagctttacgataaatgtgttcaggaacactcaaaagctaagctgattacattaaatagcagcgctcatgatttatcggatatctctaaagatgatgttatagatatttccgagggattacttaaatttgtaatattcaattcacctttatagagtaaatatttatagaaatcgtaggtaatgtgatgcaacaaagctaattctcaactgtaattcgtatatctgatgcaagactttaccttcggtttccttcagattatacttcgcgtcggacacattcttcgcctaggtcaatcaaccttttttaaattatccacagattttatcggaatataaattcctaaagaataaaaaaataaagggtatgccctaatttctttatggctcacccttaactttttaatgtcctaaaatatacatcttataaagcgcagctatgcacttatgaaaagagcagatatactgcaatacagaacttttctgcatataagaacattctatgataattgggacttgttatatagtttcatctactttacctgacacttcacctagaaaattaatattcgtaattttttacattttcacatattactatatttattttcttatcctctattacttttttatatgagcataaaaattcatttaactcattatcatttaagtctatacttttctcactaactaatataacatctaaattctctagaagtactttcaaatcatttttctcgttttttatgaaatattctgacattgttttattagatattctgcttttgtatttttcctgaaaccccattgtctttttaatagtctgatagtctaagttgcttccacccgtatcaaatccgggtattttaaattgcccctgaattaaagaaggatctactccatatctttctagaaactttttttgtatatttattaatttatcttgtgatatattattttcttccatgtaagctaatatatttttggagaaatcagacatattcattttgccctcagccagtttataatacatagaataaatatactcttcgaatttatctatgtctttatctttgaccttattttttaattcattaaaatctataattttatcagacacattaatcctctcctttgtattattatataatattaagtatttatctgttgtactttttttattatattttatttaataattgcttacttatttttttcattaccatcgttcattctttcatttttagaaaatacgcatccacaataatcttgcctatataatttatattgtttagaaagctctatagaacgtttatacccttctttcttcttaaagtcagaatataaatattttacatcatgttcttcagataaacttttaccaatttcgtttaatttagcagaatttttatgagggcttatagataatgttgttgtaaaatagtcataacctttttccttggccattatggcagcttcattaagtcttaattcataacaattaaaacatctaactccaccttctttttcctcttccaaacctttagttaacttataaaaactttccgtatcatattttccttcaataaatcttatttcatttttgactttcatttctgatataagacccttttgttccgcaactcttctagtatactcctccattgggtatatattaggattataaaagaagatcgttatcttaaaatattgtgacaaatattccaacacatagctgctgcaaggtgcacagcaactatgaagcagtaaggttggaacctcttcattttttactaaattttcaattaaagaatctaattccttttgataattaattttattcatatgtaagtcattccttttataagtttgttaacacatattctattataaactcattttattttcatttaatgcaaattcttcaaatgcttttaagaaagcatctatatgactttctttatgttgtacgcttaaaaataatgcttcaaattgtgacggaggtaaattaaatcctgattttagcatatgttcaaaatatctattaaatctattcacatcacatttcttaacatcatcataagttctaacttcttttaaatcattaaagaataaagtcatcattcctccaactctattcattacaaccggaagatcatatttttttgatatatttattataccttcttcaagtctagctcctatattttcgatgtgatcataataattctgattattttttaacttatttaaagttgctatacctgctgccataacaattggatttcctgacatagttccagcttgataaactccgcctaaaggggatagattcttcattatttcttttcttccaccatatgcaccacatggaagtccgccacccataatcttagcataagtaaccaaatctggcttaacgttaaatagtgattgtgctcctttaaatgctactctaaatccactcattacttcatcaaatattagtagtgaaccatattgattacaaagatctcttagagtttccataaaatcattttctgactttattactcccatatttccagctaccggctcaataataactcccgcaatttcattaccatattttttaaataattctgtaatttgttccttatcattatatataccaattaacgtattttctatgctttcattaggtacaccaagtgaacctggtattcctcctgtcatcactcctgatccagcttcaattaaaaaaccatcaaaatgtccatgataacatcctgcaaacttaacaattctttttctctttgtgtatcctcttgcaagtttaactgcactcatagtagcttctgttcccgaattgaccattctaatcatctcaacattatccagattagtgcatataaattttgctaaatctaattctaattttgttggtgctccaaaagccaatgccattgagctaacttccttaatagcttctacaacatcatcgtcgcaatgtcctagaattaatggtccccaggctaatacgaaatctatatattcattatcttcctcatctttgattattacgcctttaccgctttttataataggcggatttaaattaactcccttaaaggctctaaccggactgttaactccaccaggcatgtattcctctgattctttaaatatatcaacgtttttcaatttaactcctccttagcccgcataaaatctataaatatttatatatgtttatatttttattgtttcatatttacatattattatatttaaattgtaaaaaatttatatatttaaatatatatgttgcaatgcacaattcacaattacgactaaaattcttgtaatatttttagaattatggtgaataattatttttacaatatataaattttttaattactatctatttgtgttcttttatcttcttagaacttttgctgcttctaatgcatgataagtaataattatatctgctccagctctcttaatcgatgttaaagtttccatcattactctttcttcatcaataacgccaagctttccagctgctttaatcatagcatactcaccacttacattataagccacaagaggaagattgaaattttctttacaatctcttattatgtctaggtaagaaagtgccggcttaaccataatgaaatctgctccttcttctacatccatttgcgtttcacgaatggcttccattctatttcctggatccatttgatatgtctttctatctccaaattgtggcgctgaatttgccgcatctctgaatggtccataaaacgccgagcaatatttagcagaataactcattatgctaacattcttaaagttattttcatctaatgcacttcttaatgatccaattcttccatccatcatgtccgaaggagctataatatctgcacctgcctttgcatgtgatactgctattttacttaaatattctaatgtttcatcattgtctacatattcatcatggattattccacagtgtccatgtgaagtgtattcacacatacaaacatcagtaataacaagcaattctttatcaagcttctttatttctcttattgcctgttgaacaattccattatcattataactttcagaaccacactcatctttatggtttggaattccaaaaagtaatactccagaaatattagcttctctaacttcttcaactacttcatacaatctatcaactgaataatgataaacatctggcagtgatgaaatttcattttttatattgtctccctcaacaacaaaaattggataaataaaatcctttgaatctaaacttgtttctcttaccatatctctaatggcagcattaactctaagtcttctacctcttttaatcataacaaactcctccattattttagccatcttcaaagatgtcactcattttatttactatctaaatttatatattaatcattttaaaaaatctatttcctctattgcagtaaattttctatctctttcagaaacccttcctctgagtgttctttacatacgtatgcttttattccgtacttttctaaaggttcattagtctttggtcctatagctataacctgctttttcttaatttcctcaatccctaacatatcaatcatgttttcaactgttgacggacttgtgaagaatactatgtcaacttcatcaaaagatctcttattaactactgatccacaaaccgtatcatatatatatactttatctacacttgcaccacaatttgttagttcttcataaatatatttcctactttttgcagaacacggcaaaagtagagtttggttatctttcaaatgaggttttaatatgctcactaaaccttcaccaacaaattctctggcctttgcaaaacagataattcctctttgttttaaagaatttgcagtagcagcgcctattgcggatattttagctttaattcttcttatatcataatctttttcaataagataatcaaaaaatatttctacactattaactgaagtaaataccatatgatcataattttctatcttctctatataatcatttaagttttccgcactgctttctatcttaatagaattaaaacttgtaacttccgctcctaagtcaactaatttattttttaatttctcagattgtctccttgatcttgtaatacatatattctttccaaacaaaggtttattttcataccagttcaaatctttatttaaatttacaacttcaccaacaacaattatacatggagattgtaatttagcatcttttactttttgtgaaatattctcaagcgttcctactacctttttttgcttagctgaagttcctctcatcactaccgcacatgggaaaattggttcttttccattattaataagctcctccactatattatctaaattgcctaatcccatcataaatactaatgtgccttcttctttagctagagccttaaaattcacatttaaatcttgcgcagattttcctgttataacatgaaaactttgtgctatctttctgtgagttattgggattcctgcataatttaaaactgcaataggagatgttacccctggtattacctcaaattctatattttcatcaactaaagccaatacctcttctccgcctcttccaaaaacatatgggtctccacctttaattcttccaactgtatgcccttcttttgcaagtttaactaaaagttcattaatctcctcttgagtttttgaatgagctcctggttcctttccacaataataaatttcacaatttggttctagataattcaaaacattatttgaaaccaatctatcataaagaacagcagtacatctttttaataccttgacagcctttaatgttaataactcttcatctcctggacctgtacctattatatatactttactcatattccttctctcctatatctctaatatcttatttgccaattttcttcctaattcaatatgatcgtttttatctcctaaaatatcttttttaactattcttccgcctatgtcatatataccaatcatatataaatcattaccttgaatttcagaataagctccaataaggctgtgacaatcaccatttagcattctcataaagcttcgttcagcctcaactgttaacttagcatttgaatcttccattttttcaaaatattttttagcactgctagtttttagacattctattcccaaagctccttgagccactgctggtataaatactttaggatcaaaatactcagtgattatatcttcttcatttaatctttttaatcctgccgaagctagtatgattccatctaaattctgttctttcattttctctaatctagtttgaacatttcctctaattgggactatatccaaatcatttctcataagctttagctgacaagctcttcttatactgctagttccgattattgcaccttttctaagctctttaaatggtatattatctttagaaattaatacatcccttatatcttctctttccgttatagccgctatttcaaattcatgactcagctcataaggtacatccttcatactatgaactgcgccatcagctcttttttctaaaagtgcaatttctatatcttttacgaataatccctttccgcctatctttgccaaagaaacatctaattttctatctccttcagtaacaataagcattttttcactatctatattaaatttatcctttaaacttttcattattatttctgtttgtgtctgtgctaatttactttttcttgttgctatagtcaatttattcattaatttaattctacctccaaaattcatttatctacaaatccatttaaaaattgattaaataatctacaatttccttcgaaaatctgcttcttaatgctttttcagcttcacccttatcaaaagattttttaaattcatcatttccaataaacgaagttatctgtattttaagttctggaaatgactttgctttatttcgtattaatcctatatatctaataaattcatcatattcttttatagtattttctactttgttagaaagtaaaactgccccttttggatttccataattagtgtttaaagcaaatactacattttctgtacttctttgaatcggaacaactcccattccacttataaaatcagatgaatctatatatatcttataattctcttcacagtatttcttcactatgttttttaaattttcatcatctaatgcaataattataaggtgcttatcacttaaaaattcatagcttaaatcttcatttttaagtgtaagtatttctgaaaattctttggaaagttctattaattctccatcaaaagttttagagattacctcaacacagcatttatttttcacaaaatgtcttgcttttattgttcccgctttacctccgccaactattccaactcttagttttttagaaattaatgaaatataagaatactctattccttcgtcataaatattttctctattatccctatccattcttcaccacatccctttagagtctcttctttaataacttcaattgccctatttatgtaaaaatcagatgtacttttaattaatttatgtgctaaagcaatatcatttttatctttgcttttatgtgaaaaagtttgaactcttttctcgtaaacatcatttccaacagtttttaagtttttgattacatgagaaatacttcttaattttaaccattcatcatattccttcaggtatttattcattatatgcctattgtcttccatcttgtcttttcttaattttttattttcatcatctatacgacttattgtatcaatattgtaaacttcagtcctagataataacgccacctctttttccacatctctcggaactgataaatcatatattactaacctacttccactttcactaatatcttctgtttttacaactggatgtggtgctgaagtacagcttattatacattctatactattaatatatttattcttttcttcaaaagtaattacttttactcgttcatcctgtatttcatcttttattttaggatttctaacaaccaagtagacagtttggattttatgtgaaagcaaatatttcattacaagctgtccaacttccccataacctaaaaccataaatttagtacattcacgcttaatagcttcgctaaccactatcgaagaagatgatactggtatttcaaataacttagcttcttttctgaaccgctttccacaagtaatagcttcctgaaataatctatgcaattccaatgaaacagctttaaattctaaagcttcttcataagcatccttaacttgccccagaatttgatcttctcctaatattttcgaatgaaatccggagcaaacttcaaacaaatgcctataagcatccttattattagttataaaaacatattttttatattcataatcccaattaaaaatatcaaaaatcttttttaataattcttcttcatttaaagaagcattaaaataaatttctgttctattacatgtagctaaaataactacttcatttagctcctttaataattctccaaaatactcgttatattttttagacttaactataaatttttctctaatttccaatggagtattttttcttatgcctattaagcctatcacgtattgacacctcacatacttttttatttgcattttctatttatttccaaacactacattctcacaaggagaaaatgcagtaaccaaatataaaatttggatcttcacttttggactcattagctgaaactcgactcacattcgttcgctgagtaagttagagttaccaaatgatacattctcgcaaggagaaagttcagtagccaaatgtaaaatttggatcttcacttttggactctcacttaagtttatcagataaagattgttttttccaagcaattcttataagaattatagattaactctgaataatatagataatgaaaaaattttttcttgctctctatctaataaaattctaatcaaagaatattccttagaatctatcaaaacaacgttaatcgaaaaaatttctaaccttagataaacatcttgttctgctaatattttagtatatactattttcgctcaaaaaacatttaatttataattaattattaaatatttataatcagctcatataacttaataacctattcttcatagtgatacagctctttataaatattattatattaattaaatgtattttttatttctgacatatttttgacacatttaaggattatactgatatcgtaaagtagttaattatttaccccttattaattaatagaagtcgtttatatattaatgactcgccctaagcataggatcccctaaacttgtgcttagggtttttattttttaagtttatataaaacctatgtttctaaatatgcttttccttttttttataaatgagtactttttcacctactttcttagcttcgcttaataagttccgaattgtgcttcgcactcttttcatctaagatcttggttgcgcttagcaagttcctaattgtgctccgcactcttttcatatgtgcgcgcttttttcatttaagttcttggttgcgcttcgcgcttttttcattcaagatcctaattgcgcttcgcgctttttttataggtgtgtatttttttggattaattgggttatactcttaaaagcaatatcaaatttgagaggtgaaaaaattatgcgaatcccaaaacacataggcatcattcctgatggaaatagacgttgggctttatctaactcattaggcaaagataagggatatgatcacggaataaatccaggacttgaggtctttaaattatgccaaaaagaaaatattcaggaagtaaccttttatggattcacaattgataataccaaacgtcctagcgatcaaaaaatagcatttactaaagcttgcattgattctgttatgcttttaacaaaagaagattgcgaaatattagtcttaggtaatactgagtctagttgctttccaaaagaattattgcccttcactaaaagaaaaaagtttggttcaggtggaataaaggcaaactttttaataaattacggttgggaatgggatttaaatctactaaaaaatgcagatatatcaaaaaaacatattcaaccacatttacaatcaaaggatatttctagaatagatcttataattagatggggtgggcgaagaagattaagtggcttgctgccagttcaatcagtttactcagatttttatattttagataattactggcctgattttaaaaaggaagacttttataatgctttatcttggtacaatgagcaagatgtaactttaggcggctaatgttatagattcaaaaataagcaatactaataaaatttcgtaaatctaacttcttttacttcatatctctatattttgtgcttcagtatgaattatgttatcattaatattaatttatatttaatgatatattggagtgaaatttatgttaaaagtcgtatttacatatttattgattattaaccttctaggatttcttattatgtttatagataaacaaagagctattcataaagaatggagaatacctgaaaaaacactcattggtatctctatttttggaggatctattggaatgcttattggaatgtctagttttaggcacaaaacaaagcataagaagtttacaattggagttccattcatacttcttatgcaaattttcatagctatactatatttaaattattaaaatagcatgctaatattcaaattttattggacaaagtatcactgctttgtctttaataaattctcatgatattttcctaccgttaatactgaaaccattgagcctaaaagtgcaaagatcatatcccactgagtatcccaaatatctccttgagttcctaaaaaagcagttgcactttcgccagtaattaatgctacaataaattctattatttcataagaagcactaatagcaagacaaattgatattgtaataaaatttgtccatgctatatttttaacaattttgtttcttatgaaaatttctctaataattattgctggtacaaatccttgtgcaaaatgcccaagcctatcatagtaatttctactcaagtcaaaagtatctcttagccaattaaataaaggcatttctgcatatgtataatgaccacccactattaatataactgcatgaaaccaaataagaatatacgttaagttagtaaatacgaatttattataagtagttattaagaccataacgcctatcactgccggaataacctctaatacccatgtaaatctatcatgaggatttattcccgacgcaactaaaattgcaaatatacttattaataatattaaatgaaaattcttttccttcatcaatatctccttatataagattcacaaaatttaagaacaaaatcataagtgctttaaaagcacttatgatttattcataaaatttctaaagagtattaagatcaaaaggtgtattttggtatacacaataatttagccagtttccaaaaactatgctagcaggacctctccatgtgtacaacggtttttgatttatgtcatcatttctaaaataatttttaggtaaagctatttcatcgcctttttctttatctcttatatattcatccatcaatgtatttctatcatattccatatgtccagttacaaacacatttctcctatcttttgttgcaactatgaatactccagcttcctcagattcggataaaatttcaagatttgaaactttctctatatcttcacgtttgacttcagtgtgtctagagtgtggtgcataaaacacatcatctaatcctcttgtcaaatcagctttctcatcattaacccaatgtgagaacacaccaaacattttttcatctaaatcatatttaggtatatcatagtgataatataaacctgcctgtgctccccaacaaatatagaatgttgaaaatacatgagtcttgctccattccattatttcagtaagctctttccagtatgtaacctcttcaaaagccatttgttcaactggagccccagttattataagtccatcaaatttttcttgctttatatcatcaaaatagctataaaatttatttagatgctccggtggtgtattgtgtgaagtataactcttagtctgtattagacttacctctacttgtagtggcgtgttagataaatatcttaataattgattttctgttactattttttttggcattaaattaagaattgctatttttagcggtctgatatcttgagtattagccctctcattattcattacgaatatgttttcatcagataaaacctgaaatgcaggcaattctataggaatttttattggcatctttgttccccccaatgtgattattgcttattttagattattatttaattatttttgtatataaatattattatatcaaaattccacttcttatcaacattataaaaataaatataataataaaattatgtaagcttaaaaatacatttattttgctatgactttcacaagttaaactataaatatatggcataaattctttaaaccaatttatataggtttcaattcacaatgcacatttcacaattcaaaatgcggctaaaattcttaaaatatttttaaaattatgataaagaatttttttgctatttacttgcataaaactaattttgtggtaatcactgttaataaatcatagaattacttcatttacagtttatagatgtttacaattaaccatttacaaaaatttactgttgtttaattgtattttgacattaataattatacacaattattaattttttttattctttccactactataattaaatgattaaaatcaatagatctctgcaaaatttcataaatatcttttacttccatttatgctatactaatagatatacaataaaaggggcatatataatggtactaaaagaaaatatttcagttggatttattggaacttataccaaaaatgaaagtaaaggaatctatagaattaattttgatacaatttcaggcaatattgaaaatatcaatttagcttacaatatagagaatcctacatatctaactctagatagagaacgacacattctttattcaacatgtaaaatcaatgaaaaagctggggtatcttcatttaaatattggaaagaagataataaactacacttaataaactctaatctttcagaagaaaaaccaccttgtcatgtaagtctaaataacagtcatgagattttaatttcttcaaactatcatgaaaacaagatgtttgtctacaaaactttagatggcttaattttaaattctcctatgcttggaagtcatagtggctctagtgtaaatcaattgagacaagaaaaacctcatattcattgctcaatgtttactgatgatgacaaatatattttatctattgatttagggattgataaaatgatagtttcttcaataaaagatggaaaactatatcaaaatgaaaatttaagctatacattccctgccggcacagggccaagacatattacttatgctaatggaaaacactattactacgttttaagtgaattaacttctgaaatatttgtttttgattataaagcaaaatcaaatattgtttttgaaaatattcaaactttaagttcattatcaaaggactacaaagggacaaaatctggttccgcaattcgtatacacaagaataataaatttctctatacttcggatagaggaaataattctttaagtttattccatataaattcagataatggaaagctaaagtatatcgacactatttcttgtaatggtgattctcctagagattttcaattggatccatctggtaaatttctactttgtgctaatgaaaattctgataatatatctatattttctattaattcaataacaggagaattaacttttataaaatctgaaaacatcccaactccaacatgtatagaatttatttagttaaataattaatcatataactaaaagttaggtgcatattataattaagcttataatatgcacctaacttccttatctccatattatgtataaagcctttatgtctaaacgttatcaaaagtaagaatatatttttttttatttgtaaacatttttacttttgacaatattcacaaatttcaattataataaggcaatatattttttagatacagtgaatataactaataaaaattcgtaataaggaggacttttatttgaataaagatacattaataaatcatattaaagcttctaatagaagtgtaaaatgtgatctcgtaattaaaaatgttaccataattgatgtttttaataagaataggttcgtagatactattggtattaaagatggatatattgttggtattggtgactatgatgggtatgaaattgtagatggaactaacaaatatatttgtcctggacttattgattcccattgccatatagaatccagtttggtcacacctactgaatacagcaagctggcattattaaacggaatcacatctgttattgcagatcctcatgaaatctcaaatgttatgggagctgatggtataaatttcatgcttaattcttcacaaaacatcccatttgatatatattttatgcttccatcatgtgttcctggtactagctttgaaagctctggtgcaactttgctctctaaggacttaaaagatttttataaaaatgataaagttttaggtttagctgaagttatggattatccttctgtctcagaatgtgatgataagataattgataagatatgcgattcaattactaataataaagttattgatggtcatggagctggcttcacatctatgatgacaaacacctatagggccgccaatattttaactgatcacgaatgtaataatgctgaagaagctcttgataagatccgacgtggtatgtatattctaattagagaaggtaccgttgctaaaaacttaaaagaattattacctgcagtcaatgaatctaatagtaatagattttgcttctgcactgatgataagcatattgacgatattgctgctaatggatcaattaatagctcaattatttatactataaacaactctaatttaaatccagaaacagctattcaaatggcaacactaaatccatctctcttatataaactaaataacaaaggagcaattgcccctggatacattgcagattttatattattagatgacttagaaagatttaaaatatctcaagtttataaagaaggtaaattagttgtaaacaataatgaacttgttaatttcgatacagatttagtaaaaaacgcaaataacaatgctttttataattctataaatcttccaccactaagtgaagatagtttcaaaattaatataccaaataaagacgtaaagatattgaatgcaatagaaataattccaaacaaattagaaagcattcatttaaggctcaatatttcagatattaattcaataaaagatagtgattataaatttttcacttcctcaactgaagaagacttattaaaaatcgcagttattgaaagacataaggcttctggcaatttaggacttggaatcttaaaaggcttggaaatttcagcaggtgcgattggaaccaccattgctcacgattcccataatttaataatcgctgggacaaatgataaagatatgctatttgctgctaaagaattggagcgaatgggcggcggtataattgtggttaaagataaaaatattcttgctcatattaaactcgaaattggtgggcttatgacaaatagaacatatggtgaaattgagtttgatttaaaaaatctccattcagctatcaaaattatagcaccacaaattgatttcaatccatttttaacattatcgtttttatcattaccagtaataccagatttaaagattacagataaaggtttatttgatgttatcaattttaagtttattgacatttttgaatagttataaaggcaatctttagattaagattgcctttatatgcttatactaatcaatttcatatttcaccccggtaataactattgaaatttcttttataagatcaattttcatactaattctacttaccctaggactttctattactcttacagttggtctgagcgggaatcctggtattgtttcttcaaccacagcaacttcttctgtgcttaattctacaatagttccttttggatatggaattactattctacaaaatatattaactatattataatcaaacattgttcctgcattcgacattaaatattccagtacatcacttggaaacattgctcttttattcggcaagtctgttgataaattatcatatacattggcaatacttacaatattacttagttcaataatattatccttagttaatccatctggatatccatttccatctggtctttcatgatgttgaaggactattaatttacttagactattaatattataagtagttgataaatacttatatccaagtcttggatgttgttttaatatttctttttcttcttcacttaaacttccctgtttatcaaatatctctctaggtactaatgattttccaatgtcatgtatcaatgctcctatacatagagcttctaatttcttttttgatagttgaagcgcaattcctatagtaagtgatattactgcaacatttacagaatgagaatacatataattattcatacttcgtatatctactaatgcaagcattacatcccttcgatttacgatatcctcaattaaatctactgccatctttccaatattataaaaataactctgctcttgccaagtataatcactttctttattccttactgaattattattaagtcgtcctatgttagaaaaggcttcttttattgttataattgctttttgtctaagttctggcttaataatatcttcaatttcttcattactatatttatcaactatatatattgataaaatatttatttcctttatttttgcaattgtattttctcttaaaactactccagctctaagtagaattctaccattaatatcatacagcgattttccaagtactgtgtttggctttacgttttcaattgggactaatctcaaagcttatattcccctaaataaatcattattatttataccatacccctaaatatagaccatatgtaaatagcctttctttatgtaacacctaacaataaccaaacaattaatttaattttttaattattaagtaaattaatcctaccgtatatgtgcataaatatattatattaccttaaacatcaaatttcattaattaaatctatttatttttttattgtatttattctttttagcatcacttgcgtaggctattatattaattgtactcataagccacacaatgtccatatatttcaacatattataaatttcctgcgaaaataaaactactttcattatactctttgaaggctttgccttgataggcagttcccaaagaataaaaagaaattgttttataatgcctatcaaaatgtagtttaggcaatagaaataaaacaatttcctataaattcctatttagattcacttaaaataaatttttttattacttttactattccatcttcatcatttgaatcagtaataaaatttgcagcttgtttaatttcttcagtagcatttcccatagctacaccaagaccagcatactttaccattgataagtcattaccagcatctccacatgcaattatttcttcttgttttatcccaagatattcaccaagtttttttaatccaagtcctttatctacttccttatgagtaaattctaaaaagtaaggtgcacttttaaatacactatatttctcataaatttcactaggtaattcctttatggctggatctaatatttcttgtggatctatcatcatgacttttataatatcttcattgtcatcaacttcattgaaatccttaatagtaatatcaattccattcattgcagcttcatactctgtatattgactagttttaggcgctattaatccatcctttgcagaaaaagcatgtacattgacattgagtcttttgcttatttcatatatatattttaaatcgctcccttttaaacatacctttgaaacaatttttcctctagtattttgaactaatcctccattaaagctaagtacatagtcctcacctttttttaaatcaagctcttctaaatatctatttaacccatctaatggtcttcctgatgctaatactatcttaacacccttttcttctgcagcttttatagccgcctcagtattttttgaaaccttcttatcagttgtaagtaaagttccatccatatctagtgcaagtaatttatacattttattcctccatttatataatataattttcggcatatttattggtatttttttagatatatatgttgcgattaaattgctacattataaatatttaaatcaccaaatgcaatatatatatgaatatgttattacaacaatatattatatattcattgttattatttcttatagtttacagtgattctataggaatttcaattattattaataaatctattccaaaataatataaaacctcaaaatttgtaactaatagtagttttctttcatatcatgaattgtatctaaaacttatgaggtaatagttatgcttgagtctttattattagtatcttcgttatgcatagattcttttgttgcaagtattgcttatggtacttctaaaattcgtattccacccatatgcgcagtagtaataaatttagtatgcaccattacacttgcttgttctttacttattggctcaatagttaaaagcatactcccaagtaaccttcccgcaattttaggatttgtacttttgatgttacttggaatatatagattatttgaatatatctttaaatcatatatttcaaaatgttcaaaatccgatagtcccttaacatttaagatctttgattttcaatttgtcttgcaagtttatgcagatgaaataaaagctgactttgataactcaaaatgcctaaatattaaagaatcattttatctaggtttagcattatcattagatagtcttgcagtaggaattgggtctagcctatgtaacattaactatacggaagttttagtattatgctttatcataggagtttctctagtatctcttggggtagttattggacgaaaatttgctcaaaaagtacaccttgaattatcttggttatcaggagctctacttatattattagcaatacttagagtattaaaatgataattttacacccagttcatatagtatattattacatgaatactataaaaactgggtataaaacttttctattattttcttgaatattcagaataatattctctatttatctaaatctacttctaacacttagaatcataattattatcttttaactacagcatgctctgcttaataattatctttaacttaatactataaatttacaaatctattgaactgcttatctaattcctctaggtctgattgtagaaacttatgaaaagtctccttttctaacctatatgaaaatattggagagtttaaaaactttaaatacttttctgttacctccataatttcttcgtctgggactttataaacttctctaagaagatcaaagaatgtaccgccttcatactgctttaaccttctttcagccgcatacataacactcgtatacttatccccaccaaataaatctacctgttcttgtattgatccatatccctttttaagcatatcaatatattcatctataatagcatctttggaatttcctatattttttctcgctattatatttttcaaaacctcatatgccttttcttctgatatccaaaacgcctgctctaatatatccgtcatcttatagaaagttttacctttaacatttgctcttgcgcgttcttctatatattctaataatctctcttcagtagccgttaacatctctatccccttcttcctaaagttccattatttttctcaactgatatatatctatattttcttcaaaaagtttagataatctatcatattcattatctttatattcatttactttttctataattatatcttctgtaacaacaatatcgttgttctctttaagagatttaacaaatgaacttataaattcttctgaatcaaacataccatgaagataagttcctgcaacaattctttctttgtcgcatacacctacgatatcaccatctaaatccttaataaaaggtattgctttcttaccaatcttgcttattccattatgaatttcatagccacttatagtgctaccttctatagacttaattgattttagatcacataaaatatttcccttagtctgctttgtaactttcgtctcattaaatcgtgtctttatatccaaaaatccgaaaccatcctcttgagatatattaccctcaacgcctaatttatcgagtatcaacgttccaagcatttgataccctccacaaattcctaaaatgggtgtaccactctcttttaattcttttattttatcaaataatttattttctttcatacttcttaaatcttcaattgtattctttgttccaggtattataattaaatttggattttttaattcactaggtttatccacatatcgtatagtcacatctggaattctatctaaaatactaaaatcagtaaagtttgacatatgagaaagcctgataatagcaatgtctaaagttccaacttcttctttgttcctaattctttcagttacactatcttcatcatcaatatcaaatttttcatatggcataactccaaggactggaatatttataatatcctctaactgttttattgcaggtttaaatagttctatattacctctaaacttattaattattaccccttttattctttcacgctctgattctggtaataattgaattgtaccaactatagatgcaaaaactccacctctatcaatatcggatactaaaattacaggtgcatcagcaatttctgccatagccatattagatatatcgctatctttcaaatttatttcggcacaactcccagatccctccagtacaattacatcgtgctttttgcttagcttatcataagctttcttaactctgacctttaaagtttcattaagttccttgtatttataaggctcaatattacaaaaaacttttccatctgctattacttgtgtatattcaccacttggttttaacaaaaccggattcatcaatgcatctgcctctaatttgcaagcctctgcttgaactacttgtgctcgtcccatttctaatccatcttttgttacataagaatttaatgaaatatttaaggccttaaaaggagctacatttaacccttgattttttaaatatctacatagggctgttactaaagtacttttaccaacagaagacgctgtacctaaaaacattatactttttttatccatttctttactcccctcaaattcgagttccaatacttaacatttatttttaatccctgatttccaacatttgaattcaaattttgaattatttttctaaatttatatctttaatctaataatccgtttactgttaaatatccataattctctgtaatctctgtaccactcttattaaatttgattgaattcttaaatataggaccatcaaaaactaatgtatgatattctccattttctccacaaggatcacatcctaagttttttatttcattaacaacatcttttgttaattcttttcctaagaactctattcctagcgcctttagatttacctttttaattatagccttaaaaccacagtctataaattcattagtaagcttttccctattttcttgccataaaggaaatactcctttaatttctgctgccttgcacctatctaaacaccaacctctatgtgcttctatatctatatctccaaacacacaaatttcagcacctttatcttttgaaacttttaatgccatctcaaattcttcttcataattattcttattgctacaatctatttcaataagtggaattcccaattctttagaaatatcctgaaaaacattccttggtattttatgaaaatacgaatcctttttgctttcaaacgtaactaataatcctattattttataaccacttttaatcatcctatacaaggctaaagtacaatcttttcccccgctgaatgaaactacaactttttctttatccatactacccctcttatttgtttttactttaattcaaattcagcagcacattttccgctaaactttactattctatatttcccagcagttaaattctcaaaattttctagagaaataacttgactacttgtttttccaggctctaaattataagcgatttctataaacattggttcatctttaaaagggactttactccatttattatctataaatttttcaactgcatattctactccataataagctgattgttttccattgtttgtaatatacacagtaatttctttagtattcagaccatattcagtcttttctgttttcatagttatattatttttaaattcatcattaatttccgtcgcatcattagttgagtttttttcaacccaagatccatctactcctaaatagtatccatcaacagtatcattggaaaccatttctccattttggcttaaataataccaagctcctttatactgaacccaacctgttttcatggctccagattcactcatataataccacttgttattaacattaatccatcctatagccatatttccatcgtctttaaggtaataaaaattcccattatcatttacccatccagtttttacactgccatttttataataactccaaccattattgttattgacccatccattgctaatttctccattaactttaatagagattcctacactcattcctacaagcacgctcattattgaaacaataaattttctattcatatcctgctcctctcattatcaaagcttaatatttcatctgattccaacaataaaattaacctatacataacttaaattattgttcatttctgtgcagttcaaatatatttttcattatttttatcagtttgtaattctcttcatgacttcgtacagcaatcctataatatctattatctaatcccacataattgctacaacttctaattaatatattattctttaatagttcttttttcaaatctattttgatcagagtttttaataaaataaaattcacacttggttcaaagactttaatcccatctatttctcttatttcattataaaggtattttttttcatggtctataaattctatagatttctttatataattcttttcattaagtgctgcttttgttgctatttctgccaagatatttatattccaagcaggagatgtagtttctatcttctcttttagtgttaaatcgctgcaaatagcataaccaattcttatacctggaagtgcaaaaaatttggtcaaagattttattataattaaatttttatattcatctatatatggaatcatcgaaaaactttcttctctaaaatccaaaaacgattcgtctattattaccctaacattatttctctctgctttgttcaaaattctttttaataaatctatttcagttataacacctgttggattattgggattacatataaatactaaatctaagttttcatttatatcatgtagaatatcttctcttatattaaaatcattttcctctttcaaattataataaataatattactatttattgcctttgctgcctcttcatactctgaaaaagttggagccaaaattaatgaattctttggattcactcctcttactgcattaaataaaacttccgctgctccattacctaaaatcaaattttctttgctaacattttcaaacttttctattgaatccttgagttcaaaataagttatatcaggatatttctcaatttcatctataccttcaataatcgcatcttttacactacttgacattcccaatggattaatattagctgaaaaatcaattatgtctttgtaatttattttgttttctctacttatttctttagcatttccaccatgtccaaagcttgccatgactttcctccctatgcatagtgcatatatgtttcaattaaatttctccacttcaatcttaatttatttttagcttgttatacgcttaactataaatttattatttcaatatacacattaattttaatttaatattaactctcacatctctatattataatattcgttaaccactcaaatttctgacatttaaaacattgttatcattagctttctaaatattaaagtgaatacaaatcctataaaaaatgataaataaagaaccttagcagtcttcttaacatcattaatatcaatttctttaattttatctcctattgtaggcttacttacaagttttccaaaataataatttgcccctccaagctgtacccctaatgcaccagctatagctgcttctggatgtgcactattagggcttgtatgattatatctatctcttctatatatcttaaagctatttttataatcatatcctagaaatgcagaagctaatattatcaacatgcccgttatcctggctggaataaaattaaaaacatcatccaatttcgccgaaaaatatccaaactctatgtattcatcgttcttatatccaaacatcgaatctaatgtattcaccgctttatatgcgaatgcaagaggcgctccaaaaatcatagcataaaataacggagctataaccccatcagccatattttctgctatagtttcaacaactgctcttattattccttctttgctcaaactcgcagtgtctctccccactataaatgatagctgctttcttgcaccatctaaatcatttattaataaaaacttaactactttatatccttcaacaactaatgctttcgatgatatacaaaaatatatcaaaatcccctctaaaataattccgaagtaaatattgaattctctcgataagttaacaattgcgaatgcaattgcaaatattattgacacagtaagaatccatacaatgagacctgctgcttttaaatgctttctaaggattcttctaaacattgcttcaagttttttagccacatatccaattcctctaactggatgaaacggattattaggatccccaattaataaatccaaaacaaatcctatactaagttcaatcatatagttctcctcgttattttctttcgcatctcaaaaataattctaatcatattttcttactgtatttgagatacattttctatttcaaattgttcatcttctcttatttttattgtaagttcgtacccttctccattgctaggctgccactcatagaattttttcttactatcataaaacatttctaatagcatacctatacttcctccatgaatcactccaaaagcagtatctatattttctttaatgatataatttataagctccacaaatccatcattaactctttttctaaattctgctctgctctctccgcttggacattttacatttccttcttcgtcttctatccaagttatatactcttttagcagttttagttcttcatatgatcttaattcaaaatcaccaaaatcatactcaaaaaacttgtttaaaactttatacttattctgcggacaaataatttctaatgtttgatttgctctctttgccccacttgtaaagtaaaaatcacactttgtatatttaacccttctagaaatttccattaattgctctttcccgctttcacttaattcaacatcacttttaccacaatataattgtctttcattgcaataagtttttccatgcctgaccaaatataacttaatttctttcataccttaatcgctatagttttttcaattaaatctataactaatttacctctttctttaaattgtattatttttcaattcctcttcaattccaaaaaatattctatatacatgggaagaatgctttgctagaaactgaagtaagcgcccagtttcttctctccatattctatcaaatttttcgattggaacaattccagaatttatttcatcacatattattattttattttctaacaaatccattttatcttttaagacttctattgggttaagcttattagaaatacacgctttaacaaaaatatgtaatccacatatgatttccttattatattctatattttcatctctacagaaaaatatctgttcatgacttactttatatttttcttttacataatctaattttccattataggctccaccaaaaattaatttcataactgtccccttcaccttacggaattattcctagtattaatattccaaccacttcacctataaccaaagcaaatccagcaacatctccagatattccaccaaattcttttctgcatttttctactgacaatttaattcctaaactcattaataaaactaatattattccataaatatttaataaaattactgatattattaatgttattatcaatgttattatcataataagcttatcataaacattggtcccttttttaaaataagtccctaaagtactttcttttatagttgctctgcttaaaagataatacgctacaacacttctgcttattattggaatcaaaatcaatgtataaagagaactattcttttctaaaatagaatataccccccaaattgtaaaaagaacaaaatcactagaggtattactgcgaacgctcctgtagctgaatctttaagtattctgagtttttcttccttacttctccttgaaagaattgcatcgcaaacgtccataaaaccatctaaatgaagcattcctgttattataaatggtactatggtaattattgaactctttaaaattattgaggcatttaatatacttgctaaataatatattatactccacaagactccaattattaatccaatcagtgggtaaaatttcatcatattttttactccatcatcgtcccattcaacatatggagttggaagtatcgtaaacatgcttaatgccataataaatcctttgtataatttcttcataaagttactttctccttatgtttaatatacttgattaatccaaagctacattctataacattctcacaataatttgctaatcctctatttataatagctagttccttcttaaaattttcagttatttcatcatattgtatagcatcattaaatatgtaatcactcacaataacaacgttctttgcactattcataacatggtttatatcagttaatatcttatgagaaggattttttataagataattttcaacaaacatctcattagtcaaaagagaagttatactatctataagtacagtatccttgcaattgatcatattaatcacactatccaaatccctaggaacttctagtgtcttaaaattaaatccttctctgctttttttgtgtttctctattctctcttcatcttctctatcatatggattcatagtggcaatatatgtaacttcatttctatttaaggttagagctattctttctccaacttctgatttaccactcttagaacctccaattatcaaataattcatatactctaatttaagcccaaaatgctattaaaaataaattatttctctatacctatccttgagcctattcctttctcatatggatgttttacagctttaatttctgaaacataatctgcaagttcaactaacttttcattaggattcctaccagttagaacaacttctaatccctttggtttcttttctaaaaaatctattactttacttaaagaaattaaatctaaattagtagatgcaatcacttcatctaatatcaataaatcaaaattttcttctacagcctttttagtaaccttagaaaatctttcctcatgctctcttttagtctctatctgctcttcttcactcataaatttaaaaaatttctttactggagcacctttaaaaacttcaaagtcatttcctagcttatcaatagaatttaattcacccgtctcattatcctttaaaaattgtgttaacaaaactttcttctgacgcccaacagctctcattcccaggcccatagccgctgttgtcttgccctttccatctccacaataaatatgaataagtcctaattccataaatactctcctttcttattcataaaaaaataagtaattttatattcaaaaatgctgattaatcattactctataaccgtttgtcaaaacaaatatattattatcaaattattaaaacataatatcatcagttttaactgctttacatactcatatttttatagagtatacagttattataacatattctttaaattccatattaaccccactatgatgatcttttacttcctcgcccgactaaaaatatacgccttatacaaagcagctatacacttaagaaaagagcatctatgctgcaatacggaacttttctacataaaaaaatattccttagtagttttttacttattatttactttcatgtgccttattaaattataaatagttaatttaataccctgcaatcatttaaatatttatcatttattcatagccttaagttcatctaaataactgtcgttgatttctgcttcttcaaaagttgccatgttattcataaccgcacacgcagatttcattattgaaaatgctaatgggcatccgcttccttctccaagtcccatatctaagtctaatattggacttaagcttaactctttcattgcaactttaaatcccaactcctttgaatcatgtgaagtaaacatataatctctagtttttgaatttaatttaaaggctataagtgcagcaactgctgatataaatccatcaataacaactggaactttataataagcagagcctaaaaatactcctgccatagctgctaagtcaaaacctccaactttcgaaactacatctattggatcatcttttgctggattgtttacctttattgctttcttaataacttccttctttttctcaaatgcttcgtctgtgattcctgctcctcttcctacaactgtttccactcttacgtctgttaatgccgacaacacggcactgctagtagaagtattgccaatccccatctctccaacaccaagaatttcatagcctagttctttcgcatttttaacagactctattccaattaaaattgctttttctgcctcttcacgtgtcattgcaggaccttttgcaatattattagttccttttcttatctttttattaattacaccaggatagctaaaatcacagttaatgccaacatctatcaccataagctcagtatcattttcttttgcaagaactgctacacctgttaatccttttgtgaagttaattgtttgggccaaagttaccgattgaggtgctgaagccactccttcttcaaccacaccattatccgaagacattattataaccattttttttgttatattatttttcactttgcctgtaatgcccgcaagttttatagcaatttcttctaactttcctaaactcttcagcggctttgcaagtgataccattcttctgtctgcttcagcgattacataagcatctgcttctcttatgctattaataatatctcttaattctttagaattaatgttcatttcatttcccccaattatatactctattattttttgttttaatataacataaattcataaacaatgcgtataatttattttttatctttaaaatagttcatttcacattcgaaatctaaaagctgaagattttgttcttgaataactcctatcagaagtttcgaataaatttcttctcccttgtcattttcaactgtactatatccagccttttctatagcattagcctgatctagataatcagccgcctggaaaactccactttgtttatatcttttattattgctgagaaattccccataatctttcatggaatcttctttactactatatacccgaaagtaatcctcgattttttgtttataatactctgaagtactcattttaatttttttccctgtccatcctgaatctgcttttattccaaatagattattggctttggtacttaaatctgattttccccagccactttctaatattgcctgcgaaatagttatagaaggaagaataccatacttatcatatatctcaattgcttctggatataaatcattaataaatccttgcttagattcatcttttaaattatttttttgagatccaatatattttaaatcatctatatacttatatacttttcctttttgttctttatcaaaagataacttatctaacactgtatccaaatcaacgagcttatattgactatctttaattttaatgcttgtactactattgttatctatgaacatattagctaattgatttatgctactatccgttgccttagaaaaatcatttttgtatctaacaccatcaatagccgccatgaacttccaatttacttgaagtttacctttgcttgcattatctgcatcctgtatatacatttttgtgtttaaatcctgtaggtttatactattatattttgccatatagccgctataaactccaaaaatagcaaaggtaataataccaaaggctataatatttagtacaactcttttaaatcttctttttctcgtgttcataataattctccctctcatcccacataaaaaatatataattataaatgaacaatcatagccaaaaaaacttctcttaataagctataaaatgttatgctaaaataataaaattacattcagaatttcagtaacccaatatttaatgataaattatattatctataagttatatatttaaattatataatgtaaatataaatttcagataactatttttattaaacttctattactttttaaataatatttcgacaatcacttattattttaaatatatttttaagtgtaattactaaaaaaattattaatgaattaacagctagcttctttaacataaacatcatatatatatgttgcaattcataattcataatgcacatttcacaattcgcaattactgctaaaattctttcaatattttcagaattatgataaagaattatttttgcaatatatatttgcaaaaaaataaagagcctctttttgtgatatcatcattatcccaagagtactcctcaatttagttataatgtatattagtttgctggctcccatttgcagcgaactggcgatataatagcgctttctttctttaattccttgaatgcattatcaatttctttacgatctaaaccagataacttttcaacctcacctgcgctaactggctttccagcctctctcataacttctaaaactttttctttaacgctcattactttaactcccttcagtatgaattatttattttctttgattatattccaaaaagataatttaatcaataatcattttccaataaaatctattattgattttagatattctttcttgtgtacacaaaattcatgagctcttatattaaattttaacttttcatcaattgaaaaagccataatatagtcatagcgacctaataccagcttcttaaattcactaactgatagctttacaatcttctccacttcagatccaatattaaatttaggatcttttatattatataaatatacttcacatatttcattatttaagaagctatttagattaagtttttctcttatacttccaacaaatcttaagttcctagaattaatttctattcctatttcttccttaacttcacgttttaatgcattttctatttcctctccaatatcaacatgtcctgctgctgatatatcatataatcctggaaaatcttttttcttatatgatctctgttgaagatatatccatttttcattgctagactcatctactatccaacaatgaacaaccttatgtagaagtccatttgcatgtatttctgaacgagaagctataccaatttcatttaattcttcatcgtaaaatgacagtttctcttcactttccgtaagaatctccccttttatctattttctttcaatgaaaacacttttatagctatattaacatcccataacaaatacaaattccagcattcacttttaagtaattttgaaattaatatataatttttttatctttcatcagaaactctactaatttttcttcatgattaaatactaattcataattaaattttggtttctctattactattaacttaatcttggcttcccgaactgccttaagcttttctagaactccaccttctttaccactgtctttagtcaaaattgccttaatattatattggcgaataaatgctttctccagttcataagatatgggaccttgaagtgctataatatctttaatattaattcccttctcgactatcttttccaatactttaggtgatggtaaaattctatgtatcactctatggttaaactctaaatttacaaacttagaaacattatttccgcctgtagtatttaaaatatttccgtctatattttttataattttaatagcctcgtcataatctttaactcttactatatcttctccagtaatacgctcaagagcacctaatctttcatatcttatatacttaatcttaagataatttgcgcactctaatgcagtctttgtaacttcttgtgcataaggatgagaggcatcaactagcatatcaatttgattgacctctatccattttagcatttcttctgcattcaaaggctttgtgtttagctgctttatattaaattccttgagtaactctcctccatacgctgtagcagttgtaaccgcaatgtcactagtatatttatttattaacgataaaatttttcttccttctgaagttcctaaaataaatccaatcatactttctccattccagattgccaagacacattaaaaaaataacgagccaaccatgctaatttatttcaaatttatgtagtgcatcattaactcattattttctttcatatacctaaatacaaactatctctatcttttattttcatagcctctaggtgttataaatttttcatctttataataactttttgaatttcctactattacaatagacatcatatctactatatcttcatcaaaatctttgatagtaaataatttataactttgcccttctctaagtgcatgtcttactactgccactggagtgctatcctgtctaaactcccttattatatcaatacactctcttaaatagtcaggtcttcctttacttttaggattatataaagatattacgaaatctccttctgctgcaagttttactctcttctttatatcttcataaggtgtcattagatcacttaagctaatattgcaattatcatgcataagaggcgccccaactacagatcctgctgcactacttgcagtaatacctggaattatctccacgtcctcatcttttttaagttcaagtatcaatccagccattccataaatacctgcatctccagtacttattaatgcaacatttttatctttacataaatttaaagcttccttgcatctagcttcttcacctttcattcctgtcgaatataactctttatctttaactaagtcttttatcatgtcaatatatttgttatatcctacaacaacatcactatcttcaatggcctttaatgctctcaagctcatattctcaatgcttccaggccctatgcctattactcttaattttcccatacttcactcaacctctttcgcttcatttttatccttggaatgaaatctaattcttattatcattatctaattctatattatagcatttcactctaatataggtaagatagcatttgcaatcttaaaatgcaacttacctattgtatatttttctcatccaaaaaatattgataataggatattccattacctgaaataaagtattatattttgaaatattgctttttctctactcacatttctatatttatggggtatattggctacaaatttaatagaattacctttttgtagtgaatacttttgatcatcaatatctatctctacttcaccttgagttactataatatattcttcaacaccatcactatgtggagtagatacatgattgcaccctgattctaattctatagtgaatatttcaaaacccctattggcatcgaaaggaaatataggatataacttcattctggcatcgtcttctataatcggatcaatattattttgatccactatctctaattcatcctgctcttcatcaataaaaaaggaaaatgatacctttaatccagttgaaattttccataaagtcgatactgtcggatttgattgtcctctctctatttgacctaacatagctttactaactccagtcaattttgctgcttcatccaaacttaattctctcttatttctgatttcctttaatttgcttccaataatcgaatttaaatttctcatattctactcctttgctcgaaatattgtatgtcataacatatatacaaataatatattgcacaaaatattgttcccgtatataatataacatatcttactaattagattcacaacttaatttcaaatattttagataaggagtctttcaaatggcaaaagcatttctattaggagtcgcagcatcatttttctttgcattcacatttatattaaatcaacaaatgaatatttctggcggaagctttttatggagttcatcacttcgatatatctttatgttaccactgttgcttattattatgattataaatagacaattaaatcctgtattaaatgatataattaataaacctattcaatggatcacttggagtacaataggctttggattattttacgctcctttaagctttgcatctgcatatggtgcatcatggctagttgctggaacttggcaattaactataattgctggtgctcttatgtctccattatttttcaaaaatattaaaacacctgccggaatatgcaaagttagaaatacacttccgaaaaaatccctgttaatgtcctctttaatattactaggtatatttttaatgcagcttgaacaatcaaaaaatgtctctttttcagaaataatctctgtagttattcccgttattctagctgcatttgcttacccacttggtaatcgcaagatgatggaaatctgcgatgataaatttaatacctttcagagagtattcggaatgactttatgtagtatgcccttttggatattaatatcaatattcggggtattatctgctggtatgccaagtaaaggacaattacttcaatccttagtcgttgctattttttcaggaattattgccacaatacttttttttaaagcaaccgacatagtaagtaatgatacgcataaattagccgttgtagaatcaacacaatccggagaagtaatatttactcttataggtggagtatttatatttcacgataagtgtccaacatttgttggactagcaggcatagtactaatagtaataggtatgattttaaatagtattgttaaatcataaaattattgatttaacaaaaagccagctttgaccattgatacttataatcaattagtctcattactttttacgactagaaatttttatatttccgttcttgtaaaaaacaagaagagatgttgcttcttctacttgtcaataagtatttttcacaacatctcttaatatttcttattcttctgctggcttgaaagttccttcaataaatttattaggattaaatatatgctctattcttggtagtgaaatccccaatgtttctcttagaacatcttctactgtttctactgctataatagttaattgttccttaacttcttgtggaacctcatttaaatcaactacattatcctttggaattagtacttttgtaattccggctctttgagctcctaataatttttctttaagtcctcctattggaagaacagctccccttagagttatttctcctgtcattgcaagttttgaatccacttttatgcctgtaacaagtgatgcaagtgcagtaaataatgcaattcctgctgatggtccatctttaggaacagatcctgatggaacatgaatatgaatatctctttctctaaagtttatagcattaatcggcaatcttgattttaataaacttaaagagatttgcgcagattctttcataacatcccctagctgtccagttaagacaatttgtccacttcctagcattcctgtcgcttcaatgaaaagtatttctccacctacagatgtccacgctaatccagttacaactcctggaacattatcatcttgagccttatcatggcttgaaacctttcttcctaataagtcctctaaatcatcttctttaactttaaaaggtaattccaccttattagatacaatcttttctgatgcaattcttgcaatagttgctatttgctttttaagtcctcttactccagcctctagagtatattcacttataattctttctaatgctgcatcttctataacaagctgagtatcatttaatccgtgttcttcaagaactgctgatatcaagtgattctttcctatatggaatttctcattcatagtataactagaaatttgaattacttccatcctatctaataaaggccttggtatagtatctagagagttagctgtagcaataaagaatacattagataaatcataaggtacatctaaatagtgatcagtaaaagtatcattttgttctgggtctagtacttctaataatgcacttgctgggtctccattatagctagccatcaacttatctacttcatctaaaaccataactggatttatttctcctgctttctttatactttgaataattcttcctggcattgcacctacataagttcttctatgccctcttatttcagcctcatcacgaactccacctaagcttaatcttacatattttctgtttaaagcttctgcaatactctttcctaaacttgtctttcctactcctggaggacctactaatagtagaatagaaccctttttatcatttttaagctgcataactgctaaatgttgtattattctatctttaactttttctaatccataatgctgttcatctaatattcttcttgcttcttctaaatcaatgtccttaaattcttgttttttccaaggaagctgaattaataattctaagtagtttttaatcacattgtattcagcactatttggactttggctttctaattttcctaattcttctaaagcaacttcttttatttcatcaggcatttgtgcctcttcaattctatttaagtagttcttgtcctttttagaaggtgagctttttccttcatttaattcttcttgaatagcttttaactgctctcttaatactgtttccctataattcttattagctttttctgtgaatttttctgctaattcaaattgtaattttaaagattctttttgttttaataaataatctataaatttaagacctctatcctttaatgattgagtttccaacaaatcatatttttcctcacttgaaatttgcatgaaatgagataaatatcccataagcttattcaaatctttttgaccttctacagccaacataaacttttctgatcccttaaaattctcactaatttcacgagtaacttttttaatatactctaccatttcgtccttacttttttctgtaagatcaataatatcgggtgcaaattcgaattcggctttaatagaatcttcctcaatactaaatgttttaatttcaactctatctaatattttaatttcagctttatatcccttttctgttttttcaattgcatttacttgaaatgtaacaccaactctatgaaaatcttcttcctttaacttactttgaccaaagttttgttttaaaggtaatgcaatattaactatatcttcatctgataaactttcaatttgagtttcactaaatttattaaattttagtgtatggtacattccaggtaataacactatatctgacacaggaattactcttcctatattatttttatcatctaaatttatcataataatcatccttcctattagaacattcttaaacgagcattcatttaaagattagttaagcaatagcgagatacttctgcaattatatttcacaaaatctctcgcactaaacacagtccttttaattatataagtaatgcctcttgcactattctaatgagttcctttagcaactcaattttttcattttcatcaatacatgaattaatagcaattgattttactggataaaaaagtattgctcttaaattatcattttgaagatttttaaaaacttttctttctttcatttcatcaagaaaattatttaggttatttattcccctcttagtcaaacattgatttgataaagctggacaattagcaaattgatctacgaaatgaaagacttctccatgctccctaatataaataaaatactctttaacaataatttcaataacttgctgaccattcatcttattgttaagtttactgagtatgtaatcaaaaatatcttcagaatattcaagatatatgtcttgcaacatgacttctttattttcataataaatatatactgtagcaggtgatacccctgcctcttttgctatcttcgaaatagacgtaccgtgaaagccttctttaagaattaatttaataactgcttcctttatgttcttttgcttttcatcgtctttccttctcatttaaacacctctattattatatttctataataaatgaacattcttttattgtcaatatatattccaccaattttatcttattaaatgttaattttcttttaaaatctacataaagaaacttaaaacataatttatttgtttttaatctagtaaaaaatacataactcctaattattaaaagtattaaaaatcgctattcaactttaaaatagcgatttttaatactttccaaacttttatgtttaaaataagaagtaatttaaatcaaacaatgccttacatattcaatacgtgtctacattcgctagcacattgactacatacatcagcacaagtttgacaatgttcatcattgaatcttccgcattcttttgcacagctttcacatacggcagcacatacagtagctatttctcttatatgaccacttcctcttgaaataaaacaagctgttgtagagcaaatttcagcacaatcttgaagtgatttaatacaatacatcctatctctagcatcactatgttgtaaacataaatttaagcattcctcacatatttgcacacatttactgcaagcatcaatgcaatattgcattggatttccttctgatattaatgaatttgaatgtctggtcatagttgcttccatttttgtttcctctttattattttattgataacaaaatatattttcttctaaggcactaaaaatatactttgtaatttctgcttaagtcgcctataaaattcaaaaaggatacatttgatattttttatataaactttttagtttatcttaaatctttgtacttaatatatttgtgcatcaaaaacaggagcagattaattaacatctgctcctaatttatatatgttctatatttaaattcttttatacaagctaacgacatgtacttcccaaaactcatctacccataaaccaactattgtatcaaccgaaaaattccaatttttaatcaaatttgtggcttcttctatttgcttataatgcacctcagcatccactggattcgcagcacagtcataatgacctaccaatccaattattttggatttatgagccttaactgaaatattgatcttatcttttaatctacttgaataaaacgggttcccttctgacactatcttgtccattccaggctcagttattaaatctacatactccacattaaaattttcttttatccaatttattactggaatctgagtccttccgtcaatacaatttaaaactgtcccaaagctttttctcattcataccacctaaaactattattcttaggtaagatatgaatataagttagcgtttgctatcaatctcttcaaataaagatgataaatgaaatctatatttcatttttatctctaaattcaatttctgtaccctcaggagcctttagtttaaataagaaactatcctcaactttatatattacttcattatttttaaccctaaaattgttataacctaaacttttaatcctattaaattcttcctgaacattatccactaaaaagcacatatgaactattccttcgcttaacttattccacttagaaagattttctcccttcttgctagtttgtaactcaatcatgaatgttcctagttttaaccatgtattataatctctagtatggaaattctttgtctcttctacaatctcaaacccaagaatatttttatagaattcaagcgattctttgtaactattagtttgaatgcacacatggtgcatagcttttattcccattatttttcctccataataaatctatttatacttgtaaatttatccataactattctatttaaatacaacatattgtccctcgtactctgcgaaaacagtttccttatttttaataacaaccttaagatctaatctactcttgttatgtttcgtgtatgtttcgagaaattctcttcttgtttcatcaccaaaaatttcacattctgcagtgaaatcttcacgtataggagctctataatttatattactttttttaattactatctgagcctttgggtcagtttctttaatatttacaaaaaccatagaccatccgcatattgtcatcaaagtatttatacttcctccaaacgctgttaatttatcatttatattaggttttaatttagcagcaagtctaactctcgacttagtaaactctgtaacacttatgcccatagcttctgtaattggtatattggtatgtaaaaactgctcaaactcattctcactcattatcttacctccgatgttcatctacatgtattgtagacaaaatataatatttataaattttatcatataactcaattcaaatccaatatatgacataatagtgcaatcaaatgattattattctaatatttaaatataattgtcttaacttgtcagacatgctattgttatctatataaattctaatattaaaggagcaattatgaaaaatattacacattatttattagtttcatttattttaattttattatcatttataatgttttttattcactatttagtatttgggcaattagaaaacacgatttattactcttttatgagcctctgttttatccctataaatatattagtcgtaaccctagtatttgagaagcttgtagaaagacgtactaaacttgagcgtttaagcaaattaaatatgttagttggattattttttagtgatattggttttactctattggaaataatagtagctggtgatgcgaatatacaatatttaaatctagattttacagacttaaaaacttctaataataaactaaaatcttatgaacatataatagcatttgaaaagattaattatcctagacttgaaaaactagttctcgaaagtagagatattctatctaaccttataagtaatgagaatatattagagcatgaaacctttgccgatttacttatgtctctaatgcatttaagagatgaaatagtatttttacaatataaaacactgacaaaagatgactctactcacataaaaggggatatttgcagagtttatagggcattaacttctcaatggataaattatctttctcacttaaagcaattttatccttatcaatataatggtgccattaaattcaatccatttacagtaactagccgataataattaaagcaggagctttaatttctcctgctacaatttctataatcattaatttaaagtttaaatcttattttacaatattatgtttatttcctcaccacattttgggcacttattgtcttttataaatacattagttgaataaccactcctctcaataagcacttcattgcaattatcacaataagtattattatcaactccttgaacatttcctacatatacatgtttcaagtatttctttgcttcattttgagcttctgttatcctttctatttttgtagcctcattctccatcttatatcttggaaaatatctgcttaaatgaagaggtatattttcatcaacactagctataaattcagctatttgccttgcttcttccaaagaatcgttttcttcactgacaagtaaagtggtaatttccacatgacagtattcactgcacctttttatagtttctagaacaggctcaagttttgcgccacaaatattattataatatctatttgtatatccctttaagtctatattcatagcatctacataaggaaggagcttcttaagcggctattcattaatatagccattagtaacaaccacaacactcgtatcagtattattctcttttatgccctttgcagcatcatacatatattcataccacatgaaaggttcattataagtaaatgcaataccaatattattttctatggttgggataattcctattagtttttcaacgtttatatattgggtttgtggctttccctgggatatctcataattttggcaaaagctacaagtcatattacacccaaagcttccaattgataaaatatcttttgatggtttgaaatgatataagggtttcttctcaatgggatcaactcccattgaagttacttctccataatttattgcaatagggactttagattccaacgttctaactccacaaattccaaacttatcttcatctattaaacaattatgtggacatatcctacatctcactttatccttaacttcctcataaaacggtatttttttttccactctttatcaccttctttaaataaagtataagttattcataaatatctttgatttttaaaactatactattaaaatctttaactttaaatagatttattgtttatccttccttatatcttacaacttcaaatctttctatcttataatcatcgtcaaaatctatatctgccttatcacatgcaatttgtaattgttcatctacagtatccacgccttcaagatccggaagcaataaccctcttctcattcctaaagaaacaatgactccatattttttaggatctaaatcttccttattacacggttccgaatccataagaacatctacagatatatcaatatcatccatttcatcttctgaaacttctggaaatcttggatcactcatagctgcttctatagaatttcttattatttcttcacccacagaacctgttgttggtgcaattgttcctatacatcccctgagattaccaaacttctttaaagatacaaaaacaccgtgtctttcatttaagagttcttttggcaaattagaaatatcttctatactttttccgtaagaaaaataatgatttaaattttcccttgcaagttttacataggcattactctcatttagcttcaccttcaatttttcttctttatattttgttagctcgtctaaatagttcctatcttgttgctgtctactaagtttcattactccatatcccactccaaaagttccctgatatgataaaagctctccttttatttctttgccttccattgctccaagaagtatataaactgagttcaatccacattgtccagactcgctaatcatagttctattcatattaaaagctcctaaaacatcacctttttcaaggttacccaaaagagctttgtcaaatagttctccatatggtgaatatgaatatggtccttcctctttaagtttatgcgaaaggtctccacttgctataataacagctttcctatttaatttttctgctacattttttatctccataccaaatttatataaattgacatcccctatcattgagtaagtaatgtgaactaatttgtagtctttataatatttattaataaaatacaatgggactatacttccatgatctaattcataattaacattatatctacgtaataattctgaatctacaaggactgacggaattccctctacatgacattcggtgcgaagtttaacattaaactccttatctataggaatatccatctttatgtttgtacatctaaattggcttaaatctcccgaaattttttcttcatctgatatggctattgcatcagaaaacattgtagcatgaggtgttataattattatcgtatctggtttaatatctgctacttctctccctattttattacatgctaagcttgtttcctctattttcttttcttcacctttacctatgtcgggtataattattggtggatgtggcattaaataataacctagtatattttccatgttctcacctcctaattagaactattctttttctctagatttttcattttccttaactttttctaaataatctttttgacttactatattttcttcgaaattttctactgcatgtttagtgaaatttccaacactcataatattcttaaatttattgccttcactatttctactcattagttaaattctcctttctaaagaattatttaagctgattttctctaaatatatatgttgcaattcacaattacggctaaaatcctttcaatatttttagaattataatgaattattattttcgcaatatatataagtttttaaccaaaacagtttcaaagaaaatcacttatctctcaattttattatcctttttattagtgatttttttaatttcttccccagaatgatgaaaattctgaattgctgtagtcaaatcacttcctaaactactaatactgtttcttttatcataaggcttattcttcataaatttatctccccgaactctgatttatttttaaaaattgggtaaattatttttatagatataaatttctgtaacaaattatttcgtttttattatttctataaatatatttattatgcttgcagcatactaaactcataagcgaacaacttattattagcttcttatcaatatcagtctaaatcctcatataagggctaaaatcctatggatttggcactattcactgtattatctaatttttaatggtttgactaatattttttaacaatgttattataataattattcttaaaataattattaatttacctactttacatattaaaagtaaattagacaagtatttaaatttcatttatttaattttaggaattatatataactatatttgatgtaaaggatgattaatttgaaatcaactacgaaacatggagatgttgcaaaactgagtgctggaggaatacttatagcactaggtgtagtttacggagatattggaacttcaccactttatgtaatgaaatcaattattgaaggtaatggtggcttgaagaatatatctgaaaactttattcttggatcattatctctaattttttggacaattacaattttaacaacaataaaatatgtccttataactttaaatgcagataataatggtgagggtggaatcttttcactatttaccttggttagaaatcgtgcaaaatggcttatcattccagcaatgattggtggatcagcattgctggctgacggaacgctaactcctgctgtaactgtaacttcagcaattgaaggattagatttaattccaagttttagtgctgttttaggaagtcaagttgatattgttacgattgtaataataatattaagtgctcttttcttcattcagcactttgggactgatttgattggaaaaatgtttggtccaataatgtttgtctggttctctgtattagctatatgggggattatcggtatttcccacaattggacattattgcgtgccctatctccatattatgcaattaacactctttttagcagtgaaaataaagcaggtttctttatacttggtagcatatttttagcaacaacaggtgccgaagctctttactcagatcttgggcatgttggtaaatataatatttatggttcttggccatttgttaagatatgtttactattgaactactttggccaaggagcctggttattatcagctagacataatcccacttttacaaatatggaaggtttaaatccatttttccaattgattccaccttcttttttaatttttggtataataatttcaactttagcggcaattattgcttcacaagcgctaatttcaggttcttttacccttgtttctgaagcaattaagcttaatttatttccaagattacatattatgtatccatctagcactaaaggacaactttacataccttccatcaataaatttttatggattgtctgtatcggaattgttctatactttggaaactctgcaagaatggaagcagcttacggattatcgattactgttactatgttaatgactactattcttttatttaattacttattgaagaaaaaaacaccgctcattgctgctgtattaatccttgttttctttagtgcatttgagttttctttcttcattgcaaatatcattaaatttactcacggaggatttattgctgctttaattgctcttgcaatcttaagcgttatgtatatttggattaaaggctattatatcaagatgcgtttattagaacatgtcccaattgaaaattataaaacacaacttaatcaattacgccaagatagtgaccgtcctaagtatacaactaaccttgtatgtttaactagcagccatgatcctgaacaaatcgaaagaaaaataatgtattctattttagacaaaagacctaaaaaagcagatgtttattggtttgttaatattgctgttactgatgagccttatgtagcagaatattcggtagatactttaggaacattatatattgtaagggttcaaataagacttggatttagagtagaacaaaaattgaatgtctttctacgacaaatttcaactgagttagttgaaaatggtgaaataaagattcaatctagaaactatacaactatgccagacagaaaagtcggagattttcgtttccttctaattcaagaacagctttcatatgaaacagatttgaatttctgggaagaattaatactcaaagccaaactattcataaaaagatatactgtttcaccaacaaagtggtttggccttgaaaatagtgatgttgatgttgaaaaagtacctttattcataggaaaatataatcatgcaactttaaaacgaactccaaaataacattactgaattaactttttatttaaatataactgtccacaatttggtggacagttatatttttcctttcaatctttagttaatttctgcaatttcttttttctatagctttatatataaatataagaattgttcctattaagtatgaaatgatatcacaaaaatcaaaagttgatccaataattattttagccattttaaaatcttccatgtgcaaaagagaaaccaaattaaaatactgacctatctcaattaagcaagcaaatataaaaacatatattggtgaaaccttcttagtaaacactactataaaaaaataaattaagcatacaactaatacatctccaataaaaggtctaattatattatcatgtataaaagctccaatatatacttctattaaaaataaaactatgaaaatgtataaatatttgtagtttactctcatatcaatcccctcccattaatctaacttaaatttataacttttaagcatttattccaataatacatatcagcagaacaaaatcgcagacgactttggatctggcgaccttttatgcatcttcctttgcgagcgtatttaagaaaagtctggcagtattttttattcttttaaaatcataagccgaatcaattagtctgtttgaagaattatgccctaactgagtacatcgtccacagattttactacactatactttcctaaagaataaaaaataataaggatagaagcaccaaatctctatccttatcatgtattctaaattaatttatatttttcattatactttaacctcatataaaaactgctttaaagtattcttcttgctgcgtaaaagttatatactggaccaaccttgacaacatcacctgtttgtggtgcatgaatcatttgtccatttccaacatatattccaacatgtccagcatgagggaatactaaatctccaggttgaagttgatcctcactaacaggtcgtccaacatcaatctgtgtataagttgttcttgaaatatctatccctgtagcatgctcataaacatattctgtaaatcctgaacaatcaaatgtacttggtcctgttgctccccatacataagatgctcctaaatgcttatatgcctcattaaggactgcttgtgcactacctccagatggcgcagctacagatgaacttgatttctgactactctttgatttgacgcttgattgtacatttgaagctactactgattgctttacactttctgcagcaatcctatcttcctcttgcttctttttagccgcggctgtctttcctttttctattttatcattgatttccttagtaacaattgggctcttaatttgactatccctaatactaattaactggttaactgctccttgaatctctgttgatgaactatttgaactatcaattatatcaaactgatactttacagcgtctctttcaagttgtgataaatactgttcatcaaatttacttttttctgccttagcctgattagctaattgttcttcttctttctttttttgtgataactgatttaaattatcctgtgtttctttgttaagcttgctaatttcagcttttttatcgtctaatgactttattttagcatttaattcatttttcttgttattgatatcttctatgtaagacttgtctttccctacaatcttactaacagcctgcaatctcgaaaaaaattcagttgttgaatccgagttaacgacaaaatttaaataattaaattccaaatctcctgatgcatacataactttaactctttgtcctaaagctagatctaaatcattgatgtcttttttgtattgctcaatatccttttttgtcttctcagtaattttattaatattatctatctctattttatttttatccacagttgcttgtaatggctccatctgagtatctaaatcataaattttattttcaatatcttttatgttattttctatttccgcatatttctgtctagaagcatccaactgtgcattatcaggtgctgcaaaagcagctatggaactacttgtagtgattactgttgctaatataagtgctaaaaccttatttttcataataccgtcggttgttacaaccctttcccctttgtcatcccctgttatacataattatagcacttttagtaaccgtcaacaaacctcatatatgctgtgataatacattaaattagtttttcttctctattcttctattctccttaaaaatttggtaaaatattcacatttacttaagttgaggtttataaatatttttatatacgttagcatattttatataagaatgcagacttttacaataagaatattttttgattcgccactactttttctataatttcactattaaatttattactcaaaaaactactccattaatattattttgatttttcacctttatgttttcctagttaacaaagtatttatatccattagattttagtctcataaaagaaaaaaagcactaacttccatataaagaacagttgtgctttcattaaaatacttcataatttatgaccaatactattttaaactaatttgggaagcgtagtcgctccatgaggcataaggttaatcgtaggatttttattttgattattatcataagaaattttaagtgcctcttccaaagttctaacaacaataatttttgtattctttagcaaatcaggatcaatttctgaaaccaaaattaacctatacttttctcctgtttcacagaaaaagtaccctacatattttgagatagtataattctctctaagatctctttctctatcaagcatattgtcaaaatttaatatcatatcattaatatctttaatttctccaattccctcactgcactcagcaagtactataatggtacctccttctacaaccgcttctttggcatttatcaaagtttttattgattgataaagatttatgtcttttggtgcccctcctgcacttgcaataactatatctgatttacttcttatattgacgccgtcaatactatccaccaattttcttcctgcctcatgagctgttatatagtctccagcaaccgccccagctatatttccatcaggtcccatgactacattaaacataaatgctggtttcaccattgctgctgcttgcatcatatcatcatgtactgggttttctataatattacccgagcacacactctctcttgtcccgcttccaaatccatcatttaacgaaagtgaatgattggctgatattgttttaaatgatgcaataccaggaagtatagattttttccctcctgaccagcctacaagaaaatgatagactatagctcctgtaataactatatgatcagattcaacagcttttttatttaacataacaggagtgccatagcttgtctcccctagatatgtcatactttcttcatcgaagcaatcatgatcgtaaacttcaaatctttttgatagcttttctccaagaagtatttcatgttcttctcttgtctgttttctatgagtcccctgagcagataaaaatataatatcttcgtctttaactccgccttcatttagttcctctacgattttatataaaaatttatatggcttttgccaacttcttgtaatatctgaaattattatacaaactttttcaccttcatgtacaatatctttaagtctttcgctgtcaataggattatacaatgcctcagctataatttcatcttctgtcttactctttttaaaatcgttgctttcaattatctccaaaagattttcttcttcaataaaagccctcattttatctcttccatatttcatattaatttctttcatttatagtcccccaataacgaatttgttaacgctttcgaatttttattgccaatttatcaaagttttccatctacttttaatataatacaaattttaactatagtcaaattagaatttagaaatagtcttttattctaacacacctctttagcctcaaacatattcaattttatattaacaagtaagaaacagaattgcttgatattactaaaataataaatccactattcattgatgcatagtcacaatatatagtgatagatcgtgaacttcatgataatattcaaaatatttacttatccctttctagaatgtatacaaaaaattaaaaccatagagaaactcaaatctctatggctttaattttatatattataatttattacaagtataataaaatatcatatttaattttgaaaattcactttttctatatagtggcaattaacatcaatatgatttaaaaataataataatctctcataaagcggatgaaccttatcaccatattttgcttctagactttctcctatgtctttaacatttttctttccatctatctgcaataatatccagcttccatattcatctaaagtaatctttttatactctggaattctgaatttaagttttctaaagaacctttggaccttatggtcttgttttaaaagtatagtcacaatattatctttatccacttcatactctaaatcatcagatattttatatactaattctaaaacatctttattattttccagcattttttaccttactctttagaattggtattgcagttgctattactaaaactattagtaatatgaatgccattccattagaagctgcaaatccacttggttcagctccacctacaagacccgatatctggaatattatccctataagtccaagaatagaacctccagcaactagtccagaagataagcttataccatttgaaactttagcttctttttccttttcagatttagaattcttttctataaatagacgtaccaatgctcctgccaatattatagtagttgtagatataggtaaatagaatcctatagcaactgccattataggaaggtttaacataaataaaacaagtcccataacaacaccagcaattaccattacccaaggtaattggcctgacattattccagcagttagtgtagacattaaattagcttgtggtaatgcaaacggaacattatcaccagtaattgcaagttgatctgaaagtaataatatagtaccaacaaccactgcaacacctagaattccagctattgcaaagtatttttccatttctcttttgtctccacctattacaaaagtaaccttttgagattgtgagtaaccgcctgctactgatatagcagtaacaataaatgtcccaaataaaagtagtgatttgttgctttcagggctcttccatcccattacaacaaataatgatgtcacaataactatagaagctatagtcattcctgatacaggaagatttgaagttcctatagtaccagtcaaacgaccagaaactataacaaataataatgataaaaacattgataaaatagaagcaagtattgccattactatattaccattagatgctacaaaaccacctacaaatcctaatattataccaccaagtaatatcatattttcaacagatgaactctttccactatttgaagctttagcattaagagtttcttttatagaagatattatagtcggaataagttttatagcgcctattaaaccaccagaaagcatcattcctgcccctatatattttacatagctaccagctatatctttaacttgcatagcatttatagcaacattaggattattccacacagatcctccatctcttccaagacttgagaagtaacctattaatggcataattccaaagttagctagtatagctccagcaaacatagttaaagaaacctccataccaactatgaaccctattcctaatagtagaggattaacttcaacttcgaatttccacttataaaacgactcatttacataacttataacattgttaactaaattcaaaaatgaacttgttataacagttataatacctcctattccaaaaccaattcccatgaacttcattgattctccagcaccttctgaagcaacaagtgtttcagatatagccattgattctggatacattaatttaccatgttcttcaacaattaagtaattgtaaacaagagaagctattcctataccaaataaaactccagctgctccaacagaaaaaccttctatgaaactaactttagagcctattaaaagaattgctggtaatacgaatattacaccactagcaacagattctccaccacttgacataccttgaactaaatttttaccaagtatgcctttttgctttgcaaatacagctataaacccagaccctattatagatcccggtataccagcagcaactgtaagtcctgatttcattcccgagtaggccgttgatgctgcaaatagaacagccaatataataccgattatcaaaactgaaacgtttccacccgacttcgaaccgttagaaatgtatggaacatagctcttgccggctacaccgccatatgcatctttggacaatttattattcataagggcacctccttttatattttacaagcaatattataacacgattttcatataatactatattttttctcttcaattatttatatttttttaaatatttttatcaaaatatttaatttttttgaagatttccacacataatagataagtttagcaatataagaccattacactttaattcatctagttttagagattagcatatcaatagaattatgttttcctatgataagctataatattctaaacataaaaaatatacaatatattcgtttaatttcctaaatacattgtatactttatgttaactctaaatactatgaatcacgtcattaaagaattattttaagcttatttgaataatcaattgcatgaggataaaaacatttaaagtcactttcaagacattcgtaattattaattaactcctctataggatttactaatgggtgccttgtgttgacaaatcttgtagcaatcctatcaactgctgtttgaatgccatgtatatctctgtaagaaatgagccagttttcttctataatataattcatccttcttaataacttatctggcagacagtaagaaaactttctaagtatcttataaaaattatcagcatactcttctaatgatattgaggaataatccttccaatttttagctaagaaatgatcataaaatatatcaatcaatacacctgccaagcgtctattactttttgaaattctttttctactccttaggaagtctggatgtgaatccgtaaaggtatcaagctttttatgcataataatcccttttcttattgattgttcaaattcattttccaaagacttatttacaaagtcccctaagaaatttcctaacatattttcttcgctattatctgcgagatatatgtgtgctaaataattcattttttctcctttcaaattcctacaaataatattctaaatttataatttctataacttattgtttttcattctttaccaagataatatcactgatatgatctttggtcatttaaaagtatcatatttttctctattaattataagttcttcttcatataacacttcttatggttttctgaacaattatctaatatataagcatgttattgataatagaaattacaagtgttaaaatttaatagaaacaaatttaaataaagttctaatagatgtaactattatagtatattattgagcatttattctaaattatattaaggagtgacgttaatggagaagatagcaagttttacaattaatcacctagaattacttcctggtgtatatgtctcaagacaagataagtttggtgatacagttcttacgacttttgatattagaatgaatagaccaaactttgagccaactatgaatacagcagaaatgcatgcaattgagcacttagctgctacattcttaagaaatcataaagattatgcagataaaacagtttattttggaccaatgggatgtaggacaggcttttatttgattttacatggtgattataaatctaaagatatagttcctctacttacagaactatataaatttatggctgaatttgaaggagatattcctggtgcttctgctaaagattgtggaaactatttagatatgaatttaccaatggcaaaatatttggcaaataaatttcttaacgatatcttattaaatataaccgagaaaaatttagtttatcctaattaatgaaattatgataaacttatatgatataaaaaataggatgcttttatgggcatcctattttttctttacttagaaatatatacttctagaatctcttaaccgatgtttatctaatagatatttttcatttatataatttataacattttatagataaaccaactaagacctgaacttatgcatataactcgccgaaatgaataacatacttttgttccagtttctagttgggatatatttcatagtataaatctaacttataattggcttatctatatagacaaacaatttaagaattcgatttattagattaacatatttacaaagtcgctaaaaatttaatttcataagttgttccatttttgcttgtcacgagcttgtctcgggagcatgctgaaatggtgcaacttattatgttagaaagcctcaacttattcttagtaaccgaaacaacagagtacctgtcctttcggtaagttattgcataagtctaagttttgttttggatatctctagttcctatatgtgcgtattacattttagaaattgcaaaactatattctaaatccttacttgaatcgatgcagaattcaggtaatactggtgctccccagctatcatctcctccaacacccatttgtttacctattatattcacatgagtaaaattaacatatggtaattcttctatatgaagtgcgttttctaattccatgttgctgtatggtaaaacactaaattcaaatggagctttatcgtaagtaaatttaagaccctcattcttatgatttttaactactaaccatctagttcctgtcctgttaccacattcttgtggtactaaataccttgatagattttctattggtgtactttcatatattccaagttttgccccttcacatctgtctatatagttttcttccggccccattccataccagctaaatgaattaaactcagctaataatttaaaattcattcctagtacaggcagttcaggtaatccgctagctcctttatacttaacatttactttaattattccttctccagatacttcataagttatattaacattagtagatggcactgttggcaattgataagtataatctaatgtaatcttctcatctaattcctcaactgaaaaatccacatacttctgccccatagtagcagccagccattgactgcatctaaattcatatccattccctctatcattatctgttgttgctctccaatagaaagtttttggcgttctcgttataaactccttattattatatctcaaggatacaattcctccttcttgtttagagaatataaccttgaaatcttttacgtgaactcctatatttacatctccatgaatgattttcattttagaccctgaattatgattattcatatctgatttttctttaataaccttttgtccaaatgctacttcatatcctttttctgcccaaagtgtagcttgtgataatcttaaggaagttgtaagtacaatttcttcaagaaaattatactttcctattggaagttctatatatttttcttcgcctggagctacagatacatttagataaccatcttttattagttttccatctctttcagcgatatagtataaatcatatttatcagtattaacaaaaagattttgattcttaatagtcaccccttttgcatctagttctaattttacgttttgatataaatacttaacttcctgcgctttaggcgatatagttctatctgcataaatcaacccattcccagagaaattataatctgttggacgatctgtaaaatctcctccataagctagaacttcctttccatctggaagttttctatacaacgcttgatcgccgtaatcccaaatgaatccaccttgatacatcaaatatttatcttcaagctctgtatatttcatcaatccaccagtagaattacccatagaatgcatatattcacagttaataaacggtttctttggatcattctttaaatattcttctatgtcaactgcttttgcatacattctactttccatatcgcttgttttttcatattctctgttccatgttacaccttcataatgaactaaacgagatggatctttctttctaaagtattccgacatttgataaatatcttcacctgcataagattcattaccacatgaccaaataaggacggatggatgatttttatctctttcaaccattgatgatgcacgatctaaaactgttgcctgccattctggaaggcttcctggcacattccatgatggttcaatctgccccattttttgccatgaaccatggctttctaaatttgtttcatctattaaatatattccgtattcatcgcaaagcctgtaccataagctttgatttggataatgtgatgttctaacagcattaatattgtgttgtttcaagaacttaatatcccacaacatgtcctcttccgtaattgagcgtccacgtcttgcactaaattcgtgacggtttacgcctttaaagataattctctttccatttagacacataattttacccttcatttcaaagtgcctaaaacctatcttttgagttacaacctcaactaaagtaccattttttttctttactaaaatataaagtgtgtataagttaggctcttctgcactccataagcttatattttgcgcatctaaatataaagtcaactgatcagaaaacggaactttttcagatatagctattttatttccttttttatcttctaaatatgtttcaactgttgtttctgaatttccaatcattttaagttcagcatttaacttcgcatttttgaaatcatcatataaatctgtttttataaatatatcatttacatgagtttctggaactgcatataagtatacatctctaaagatgcctgaaaatctccaaaaatcttgatcttccatccaacttgcgctactccttttataaacttcaactgcaagtttattttctccctctcttaaatagtcagtaatatcaaattctgatggtgtaaatgtatcttcgctatatcctacaaattctccatttacccatacataaaatgctgtttcaacaccttgaaaagaaataaaagtctgcttgtttttgagttcatctttaacttcaaaaaatgttacatagcttcccaccggattatatgttttagaaatatgaggtggtcttaattcatcatggccttcccaaggatacatagtattaatatattgacatttatcatatccttgaagctgaatatgacctggaacttcaatataatcaaatccatttatatcaaaatcatccttataaaactctttaattcttaatgatggattttcactatatgaaaatctccattttccatttaaattttgcttaagaggcatggcgtcttctaatttaacatcctcaactttttcataaaaccaatgatcggaatgagcatctattctattaactctaaatatttctggattttctagccaatctaatgacggcttattattaatcatactcttacctcactttcaccttgtagagttattgcttttttaaattaaagtcgttaatcctattaactaaatgtaactcttttataaagtcacatttaattaatacttaaacatatgtaagaataaaaaaaattatgggctaatattaataggacaccttacttcgtaaccaattacattacctctttaatttatcctatcttctgaagttagatttatgctattaactaaatttatagtttcattttattatctttttagtaaaaaatcaattatattttactaaactttactaaaataatttatcacttaattgaaaacctttaatttataagatataatcagtattaaacaatatttatctatcttgtggtaattttagaatagaggtgctaactattgaacgaatatagtaaaattttagttgttgatgatgagtttattatgcgacaaggcataactcatatgattgattgggaaaaagaaggctttcaaattataggacaggcttctaatggtgaagaagctctagaaatgataaaaaaggatactcctgacattataatttctgatgttgtaatgccccaaataaatgggattgaattagctaaatttgtacagggcaaataccctaagataagaattatcatcttaagtagttatagcgattttgaatatgttaaatcatcttttcaaaatggtgctgttgattatattttaaaaccttctctaaatccttctgagttattaagtactctaaaaaagatttcaattaaaatgaaaagaaatactttagaaggagactctttaagtctcaccaatagcgccttaaatcgccttatatcaggttttgacaattatcctgactttaattattttgatacaatatttacttttcaatcattttgcttatttggtttaaacgcaaagaaaatatatgataattatagcaaacgccatgaaattattgattttacaatttcagaaatcggcaaggaattttctttagaaggatcaaatgccaattataatatacaagtcgctaatattgaaaacgaaatcatagctgtaattctaaattttgatgataaaaattataatgctctatttagtaagctagaaactatttcagaaatagtttcaaatagttttaaagaagcattttttgtattaagcaacttcttctattctaatagaaatattaaagatatatacgaaaaggaattcttagtattaactcaacaatatttttacaacaaaaatgtttctttaatgtgttcttccaacttcaaaagcccatcgccaatagaaaaatttaattttaagcgtttttcagaatcaatttctataatgcaatttcagaatgcattcaaaatgctaacaatatacgttacaaatgctattgatcaaagatctcttacagaatttgaattaaaagcattaattcaaaattctttttataatgtaattacttctttggaatatttaaatttcgatttagataagttaaattacttaaagcaagagtgctttcatgacatagataacactaaatattcagaagacttacttgtggcctataactctctcttaaatcgctttaaacaaataatagacacatatgaaaataaaataaattcacatataatcaataaaattattcaatacattcatgaccattacgacgaacaactcactttaactaatgtatctaagctatttaattttaattattcatacttgtcagcctactttagttctcataatgaagaggggtttaatgaatttcttaataaaattagaatacaaaaagcttgtgattttttaaaacaggacattcctatatcagatataagtggaatggttggctactcagatcaaagttacttttgtaaggttttcaagaaattcaccggaatcactcctagcacttttagaaaaaaaagatattaatattattaacaaacgaaaggacttttcattatgataaaattatcaaaatcaatacattctacgagcctgttttttagagttgcttcagttgttcttataagcgttattttagtatctatttcaataggaattattacgattaaaatttcaaaagatacacttgctgatactttcagcaaatcaaattataaagttttaacgcaaataagcaatgaactcaatacatttaatgataatactattaatattatgaatgcgattgattatatcccagattttcagcgatatttatcagaaaaggatcttacaccgcaacagaattatcgaactttatataatatgtttacaggcttccataaaatgatccctgataaagatctttatgatattactgtactagctgttgggattaatggtaatacttatgcagcaagtaattatgaccgccttattatagatactaatgaagttttaaatagcagctttactaaaaaagcattagataataaaaatactgttttatatcaatatttagatcatggctttacaaagctcacaaaaaattctagcaccattgtggccataaaagttttgtgtgataaacttacaagagagccctatggatttgtatatgtacttattagcgagcatacatttcataaatattatgattattttgtgggtaatggaaatagtatttctattatatcaagtgatggtactattgtttcttctagcctttcctcaaaaatagggacgaagaatttagatttatataatatatcaaatgttattttaaataataacctaaagtacgttaacactaaattaggctcttctgatgtagcaatattatcaaagcatttatcaacttacaatttcaatatagttggcacaattgataaaaatatagtattaagtgaaatatatgattcttctgaaattatagcagtaagtatattaattgcatcaatatttattgcaattactttctttgtaatacgaagaaccacaaaaccaatttcagctcttgttaaagttatgcctaagataattcacggtgatttcaacaatcatattcctgttgtcggaagctatgaagttcgtgaactatcagctaactttaattatatgttagatggtttaaataattatgttcatgctcagataaaaatgcaaaaagaaaagagaaaagctgaactacatgctttgcaaatgcaaattaatccacactttatttacaatactttagcttcaatcaagtggcttatgtggcaaggcagtacagaaaagtcaatacaaactatagatgcatttatatcgcttcttagaaatactattagtaataaaaatgaaatgataacaatacaagaagaaatagaaaatttaaataactatgttttaattaatcacatacgctacggagataatattaatgtaaatttttttgtaatgccaaatcgcgaaaactatataattccaaaattaattttgcaacctttcattgaaaatgcattttttcatggctttaatgaacggaataatggatctatacatgtgtttgtaaatgaacaaaaacaaaatctaatttgtgaaatcatagataatggcgtaggcatgacagctgaagaagtcaaaaaaattcttaatgattcctctaaaaagcatgaacatttcacaagtattggtattcaaaatgttaatgatagaattaaacttctatatggagatgactatggtatttcaatcagcagtgaactaggtaaaggaactactgtaagagtaacaatacctgctcaaaaggaatttatagagaattaactatgtgggaaaaatctgtatatcagaaatgatagctatgcacttataaaaagagtatctatgctacaatagtgaactattatgaatataagaacattttttgcaagcaaatatattttcttcttaattctctttatgatccataactttctgaatcagtcttttccataacttatatcctcaatgggcacaacatccacagatttaacttgaatataaattacttaagaataaaaatttaaaaactataatatgttgtatataagttctaaatgatataattcactccttatagtattatttgttttgaatcacctaatagtttaaggtaatctctgatgaattaaaatttctagaatatatattaagtttcaaatgcagcatattatagttttctataaataaaacatattttataattattaacttttcttctttaattcattatagaaaaattgactcataggaacttctacttgacattttaaagctaattcaattaactttccagaaaagacctctaattcattttgtcttcctgcttcaatatctctttttaatgaacttgttgattctccagcttggttatgcattaagtgataaaagtgctcttcttctaaatcatcagaaatattaatttttaatttacgagctacggcacaagattcctttagtaatattttagtttgcttgactgcttcatcattttttataatttctgctgttgttgcgttataataagcagttattacgttatatgcacaatttaatatatattttctccaaattgcagcttctatatctttttctattttacaaataatttcagcttcttgtaatattttttgaattctaattaatacattctctacttcatcattgttttccaagccataccctatatgtatcttacaataagaacttgcatgatgtattgaaaaatctttttctgccccagaaactacatatattaaactatcgacaacttggccatcatttataaattttcttactttttcagatactccaactccattcattaatggaattattacagtattttcattaatcattggttttatttgtttacatacttcttctaaagaaaaatttttaacacatataaaaatataatccattattccaatttcatcagcgctatcgcttgctaatttaggatgtacgtttaattctccatgaagattactgtataatttcaaaccattattttttattgattctaatctttttcctcttgctaaaaaataaacattagaaaaatgctttgcaagcatacagccaatatatcctccaactccacctaaccctacaacacaaattttactattatccataaataacttatcctttcaccttttattatttattcaaaatactttatctaatttatacctatttagtttatttatagtatatcattaaattaatacattgttaattttcattctttctcctcacttataaataagataaaatcactacaaacctttaatttatagtgattttatcttaattgggggtaatatattaattttttaacatatatatcgaaatttaatttctacattctatccttaactaaacacttgtcttactagaattttaaatgtgactttattattgcaacatatatacataaagaatttttctcattctaataattaattacaattaatttgctttagtatttttagaccatacttacctaatatgatctttccactgatttcttctccagaaagcatatcaaaatatatttcttctcctaaatccacctttttttcttcttcagtgaaattcataatgaaagtatacttattatttttattggaacgcatttgagctgtaacaccttgtggcaattctccctctataacactcttaatatctaaatccttaaaaagctttgaataaaaatcattgttaaaatctgctcccgttcttgctgaaatataatatgctcttccatctccatagttattaactgttaacgcaggcatatccgcataaaaatcttctttatatactccaagaacttctgcagtttctacatggattaagtcacagtaatcttttacttcatattggctctttaattctttaattttatcatttttaaattctatataattcacttcattatcatatagtgaatctatttcttctgaccaaattccagttacttctcgaagtggtcctggaaatcctcctaagaagcaaagatcattttcatccaccattccgctaaaataagtagttacaaaagttccgcctgtctttacaaattcattaattctttctgcaacatttggtcttatcatatatagcattggtgctattacaagtttataatctgatatatcacaatccatattaataatatctactgaaattccattttcccaaaatactttataagctgcttgacagctttcttcatagccctttctatatttttttaatccctgtgcatcatcgatagcccataagttttcaacatcaaatattatggccacttctgattctttaattgacccttggatttctttaatcttttttaagacttctccaacttctgtaacttctctaaatactcttgtattctcatggccacagtgatctacaacagcaccatggaatttttccgaagctcctcttccttttctccattggaaatacagaacagaatctgctccatgagccacaccttgcattgatgataataaatgcattccagggcgctttaatttattagtatcatgccaatttactagactcggagtactttccattattaaaaacggatgtccaccttttaacgacctatatatatcatgcacaaaactaacattagctgcaagatcttcagtactttcaaaatcgttatgccatgcaggatagttatcccatgtaactacatccacttcttttgcaaacttccaataatctaaacctgtgaacaagcccatacgtggataattacccatgaaattagctgttacaggtatgttaggtgttatttctcttatgggggcaatttcatttttataaaaatctattgtctgatctgtaacgaaccgcttccaatctaaattatgtccatgaacaaacatctcacccttttcagacggactttcgatttgtgaccaactgttaaatctatgactccagaaaccagtccaccaagcctcatttaatttatctaaattattatcgtactttcttttaagccattctctaaaagcatcttgacatagatcacagtgacattctcctccatattcgttagaaacatgccacataataagcgccggatgatctttatatctctcagcaagaattttatttatttcatatgtcttttttctataaacaggtgaggtaaaacaatgattgtgtctctgaccatgaagatttttacatctatcgctatttactcttaagacctctggatatttttctgacatccatgcaggtcttgcaccacttggagtagataaaattacatgaatattgttttctgccatatcattcataattttatctaaccactcaaatgtatattttccttcttccggctctattgcactccagccaaatatgtttattgatacgcaattgcaatttgcaagtttcataagccgcacatcttcttttaacacttccggatagtttagccattgatctggattatagtcaccgccatgtaaaaatccatttattttactattaagtactggaaattccttcttcataagctttccctccaatatttataaaactcttattttttaaatttaaataatttaatgaattattttatttaaaatttatatatacttatatttttacttttattagattttattttattgaacctgtcattcctgcaacaaagtgtttttgcataacaaagaatacaagtgcagttggtaatgtcgtaattactatagccatcattattaatccataatctggggagtaacttgacgctaactttgaaattataagtaaaacagttttcttttctggtgattgtaatgcaatcaatggccataaataagcattccatgcactcataaatgttataatcgctgctgctgcataggttgttctcatagttgggaaaaatatcttaaagaaaattccaacttcgcccaaaccgtcaattcttgctgcttctaaaatttctttaggaaatgatttagcattttgtctaaagaagaaaattaaaaatgcagtacaaacactaggcaaaactacagcccataatgtattcaccccaagaaagcccaatggtgaactttttaaatttgagaaaaatttgaataatggaatcatcaaagctgaaaatggaaccatcatagacaaaagtaaaatgttaaatagtctatctctagcttttgttctaaatatttcaaatccatatcctgctattgatgaaacaaggagtgcaagaattgtagttataatcgcaatttctgctgaattaactaatgaagaagcaaatcccaattctggcttaaaaagattatttaaattttccataaagctatgcccaggaattagttttcctcttgttacatcaacagatttatttgttgcactaataaccatccaaaaaaacggaaatatagaaacaaaagatgctatactcaaaaatatatatttaaatactctattcattttacttgtcattcttatctcctcctattttgaattggattatagctaacactaccactataataacaacaagataagctaccgctgttgcatatccaaagtctggtgtatatgtgaaacataagtcatatatatatttagaaatggtagttgttgcattggcaggaccaccttttgtgatattcataggttcatcaaataactgtaatgtaccaattgttgaagtaattgttgtaaataatattataggttttaatagtggcactgttatagatatgaattttttaaatggagatgctccatcaatttctgctgcttcataaatcgaatgatcaatattttgtaagcctgacaaataaaatatcatattataacctgtccatctccatgttatggctataataatcaatatcttagcccaaaatggatctgtaatccattcaattggtactgaaattaaatgtatattgataagcaatttatttactaaaccatctgatgcaaatatgctctttataataactgaatatccaactaaagatgctacacaaggtaagaaaattgctgttctaaaaaagccactaaattttaattttttatcattgagaactgaagaaataataagtgctaaaataatcattattggaacttggactattaaaaatataaatgtatttccaactgctttaatcaaagttgcatctgaaaacattctcacatagttactaaaaccactaaattttaaattattacctttacctgattgtagtgacattatcaaagattgtatcattggtaaaaacacaaataatcctattaaaaacgtacctaatgctacataaatccatccccaaaagttttctttgctgttaataccagatccaattttacgtttcattttttcaactcccttaggatttataaaaggctatttgctaaacatgtatttaaatttttaacaaacagcctttacaaattcatatttttcaaattacggttattttacctctgttatttacttacagccgcttctgcttgagcttgagttttttgaagagtttcatctatgtcagctccaccaacaatagcctgcattccttctgacataacactttctaactgatatgtgtaaagaccgtagtttacagatggaaccttttcagcccaagccgataaatctttaaacacttgttgatctccataaaattttattggcttgctataattttcacttgtacttgcagatttcaacgtacttactaaaccaattgctggaactaactcattcattaaagcatcatctgatgcaaaagtacttgctaaaaagtcagcagccaaatctgaatttccaaccttatctagaacataccagctactaccccaaggttagatgcattaactgattttggatttgaagccattcttggaatagctgctactgcccattttccactttggtcttcagaagcttgtattgaagatgaaacccaacatccacttggcacagtcgcaacgtcacctttttggaatgctgctataaatgcgtcccatccagatacttgttttgtaattcctgcatcaaccatttgcttgtatatattaatcgcatcttttaaagcttgattaccagcaatatttactgttttcccatcatctttaacataccatgaaccagctgactgcatcatagctcttagttgatttaaatcacttggatctatagttatcatagcttttccagttttagctttaacagctttaccaatttctatatatttctcccaagtaagattttgcatatcttcttttttgtatccagcttgttcaattaaatctgttcgataaaataatgctgtgacaccactatcaaatggtactccataagtcttatccccttgctgcatggattttaatttgtaatccatgaatttgcttttatctattttttcacttaaatctttaatctcacctggataagattgcaaataattttgaattttataatcttcaattagcacaacattaggaagtccatcatatgttccagatgaaagacctgtatttaatttttgtaccacatcatcttgtgccatacttactacgttaatagttacatccggatgattctttaaatatttttctttagccatattagctgcttttatattgaatgtatcatcccaagcccagatagtaattgttttatcatcttttcctttgcttgatgatgaagcgttgctaccacctgatgatgaaccacatgcaattaaactaaaagccatcatgccagttacaactgcagccataatctttttaagtttcataaattattccccttgaaattaaagtttatacataagtaattttctgatttatattagttatgtatttgtttacattgtagcattttcaatatagtaatcgttattgaaatattgatatcaatttgtaataattttataatattaatattgggatttgtactttttttggttattagcatttttttattagcttcatataaatattaaactcgtctttttcaataaaagaatttaatcttcacgttagatttatggtgataaaaatctatcatactttttgtattttttctttatctaattcttcaaaagtttaaatatatatgttgcaattcacaatgcacatttcacaattcacaattatggctaaaattctttcaatatttttagaattatgatgaagaattatttttgcagatatatatatttatttagaacaaaaaaatagtaacccctttctacaaaaaggctactgcttattttttatattctcttacaactctctctaattttaaattcagttggtattattacttttttattatattccctaattccattcaaattttcaagcagcaagtcaacagctgcttttcctaaatactcacttggtattcttattgtagttagagctggtatcatatactttgcgctaggctgatcattaaatccaattatgcttatatcatctggtatcgataatccttcctctgaaattgctttgtaagccccgactgccattgtatcatttccaatgaaaaaagctgttatgttatttttagattttaatgcttccttcataagattatatccagctttaaaagtaaatttctctgtctcgtatatgtatttattattatagatattcttgctttccataaattccttatattttatgtcccttttatccaaatatgtatctctataatctatgcattctaatttatttccaccaataaaaccaatctttctatggcctaaactgtacaaataatctaagatttcataagttgcttttcctaaatccgccatcactgaatcaaatttattttcatcaggtgaaaaatctacaaatactatattatcattggcacttgctaatttatctatgatacttaaagagaactttccgatagcaattattccattaacattcttaatatcctcaatactgctatcctcacttagcttcaccaaattaaaattattttcattacattttttttcagcagctaatcttattgataagtaatatggatctcctaattcttcctcatagttataccaataaataattcctatatccttacttttcttattcttagctttttttgcctttgctgaaacataatcaagttcatctgctatttttaatattttttcccttgttgcatcacttacatttaatgtttcatcaaaatttaaaactctagaaactgttgctatagaaacttctgctatagaagctatttcctttatagtggccaacttaacttcctcctttagctcgcatagtccaaaaaaattaaacacaagattttgctgaaaacaaatctaagttaagtgtatctcacaagcaaaatatagtcaaactgttgtgatacttttcttatatagatggcattatgcggcaattcaccgaaagtagagacattgttatttcgcaggactatgaaaatttcgctgaaagcgctaaattgcaggttgcataactaatgcttgctcccaatttcattgtgacaagcattagttgaacaacctccaattaagaacttttaacatctcattttcaaatgcctgctgcataaaaatgtttccactttctagttaataatatatcatagtataaatccaactaataattgttttgtctttttatatatcacgactaatagtcatatttgtgttggagcttaccaaaattataaatattttattccgaaaagctatgagaacttctgaaataattaagagaaagagggttccacttaaacttattccattttaaattgaataagcaaagcgttaaccctcttcctccaaatagccttgacatcttactttgtttcctccacacaagtaatttgacttcttttgtgaatgtactcgtataataaatcaaatatatatctatgccacgctagaaatgataagttctcttataaccataaatggcccttacacctgatgtttcctataaatatttatatatttacatatgaaaatatttttatacatacatatatttctttaaaaatatatacctttaatcctatataagtatatacatatatttataagcttaatgtattttcatgatcccatatagataacacaatcataaactatacttaaactatgaaatatcttccaactagaaatgagtaatatacttttgtggaatgtttcattggtaattttgatggatgtgattctttggctataagttgttacaaatgtgctagttcaaagctcgttctttgaggctagcactttgggtgcaactttatagccttagaatcacccatcagaattacccagaaactggaacaaaagtatattattcatttcggtgagctatacgcataagtatagattatagttggcttatcctattgtattaagtagattcgccatttctattgctgaaactgcactttcatatcctttattaccagctttagttcccgctctttcaattgcttgttctatagtatttgttgtaagaacaccaaaaattactggctttccactttcaagagaaacacttgcaattcccttggatacttctgagcaaacatagtcataatgtgatgtagatccttttattactgctcctaaacatattactccatcgtatttagggctcttagccatttttttagcaattagtggtatttcaaaagcacctggcacccatgcaatatcgatatcttcttctttcacaccatgtctctttaatccgtctattgcgccttctaaaagttttcctccaataaattcattaaatcttcctactactatcccaaattttaatccttctgaaactaaatttccttcaaatatattcattattttttcctccaatattttatattatttattttattttttatcaacttcaattagatttccatgtaaactaaatactaattgaacttataaccacaaatattccacctaatttatctcatctaatattactttaaatgcagtaacatgttattagaatttgattatcaaatatttagcaaatgattcattctttcttttttagtctttaaataaaattcatcattttcattcaaaggcatttgtattgaaactctttctgaaacttttatatcatttttttctaatccttctattttatctgggttattagtaattaatctaacattctttatccctaaaatcttaagcatgtcagcacttgttttgtaatctctcatgtcttctctaaatcctagagctaaatttgcatctactgtatccaatccctcatcttgaagtgcatatgctttcaacttatttaaaaggccaattcctcttccttcttgtctcatatacagaagtatccctgagtcctcttttgctatcattctcatcgaagcttcatattgttctccacaatcgcattttctagatcctagagcatctccagttaaacattcagaatgaactctcacaagcattggttcatcattatttttaatatctcctttgactaaagccaaatgacattttgaggaatctttttctttaaatgcgagtactttaaaattcccatacttagttggaagattagcttccgtttccataacaacacttaaatgttcttcttttctgtatttaactagatcagctatagtaactatctttaagttatgctccttagcaaactttatcaaatcatcacgccttgccattgttccatcgtcttttactatttcacatataactgccgcacctttaaatcctgcaagctttgccaaatctaccgatgcctctgtatgtccaatcctctcaaatactccaccattcttagctatcaaaggaaatacatggcctggtcgtctaaagtcatctgcttcacttgcagttacaagtttatttattgtataagctctttcaaatgctgatatgcctgttgtcgtatccttatgatctatggatactgtaaaagcagtttcatggttgtccgtatttttttcaaccattggatttaatccaagtttcactgcaatttcttcttccactggcgtacaaacaagtcctctcgcgtacttaatcataaaattaatattctctccattagccagttctgctggaattactaaatctccttcattttctcttccctcgtcatctacaattattatcattttcccttctttaatatcctttaatgcctcttctatactattaaacataatgctcagctccttaaatttgtattttatatatacttaaaattcattctgatgatttatatgattaaaacccattttttcttaggaattccattgtaatattgctattttcattttcttctttttcttttccaccaaataacttttctacatatttcccaattaaatcgcactccaaattaacctttgaattaacttttttatatgaaagtatagtattatctatagtatgaggtataacagaaaccttaaatacttcatcatcaacataagcaacagttaagcttattccatctattccaattgatcctttatatataatgtatcttagtacctcctcaggtgcagatatagtaaaccaagttccattactttcttcttttatggaaactatttttccaacaccatctatatgtccacttacaatatgaccaccaagcctatcgcttaatctcaatgccctttcaaggtttactttatctccagcctttaaatttcctaagttacttttctctaaagtttcgcccatcacttctgctttaaaagaatctgaatatttttcttttactgttaagcaaactccattggtagctatactatctcccactctagtttcctttaaaacttcactacacttgatttccataactccaaagccattacctgtgctaaatttctctaacacgccaacttcttcaataattccagtaaacatcttctcctccttatatctttcatctcttatttagcaacataaccttctagtactaagtcctctccaatcgttctataattaatgtcctctaatctaactgcatcatctaatttaaagaagccttttcctgctatactatttctgctgctttgtccacctattatcttaggtgctatataaaatcttactttatctacaattctctcttctaatgcagaaaaatttaaagttcctccaccttctataagtattgaatctattccttcttctccaaccctcttaaccagctctttcagattaactctattatctttatctgccacttctataactttaatgcccatagatcttaatttctttttcttttctttatctgattttaaagtagttactactattgcagctttatcactatttgtgagaactttagactctagtgggattctaagattactatctacaataatcctgattaacttctttccatcgttgattctgcatgtgagttcaggattatcttcaattactgtgtttacacctaccataatcgaatgaaacctatttcttaagtgttgtgaatcttctctagattctttagatgtaatccattttgattgtccactataagttgctatcttcccatcaatagacattccacttttcaaaatgacaaatggaatctttgatgttatatactttataaaaatctcattcaattctttacattctttttctttaatacctactacaacttcaatcccatgctgttttaacttttccacactttttccagaaactagctcattgggatctaacatacctattactactcttttaaactttttttcaattattaaatctacgcatgggggtgtctttccataatgagcacaaggttctagtgtgacgtaaattgtactttcctccacagattttgttgcatttttcactgcatttctttctgcatgagcttctccatagcattcatgataaccttctcctattatctcattgtctttaactataacggctccaactagtgggttaggatttactttacctattcctcttttagctaattctaaagctatctccatgtacttctcatccaaaactaatcatctccaatttttcatactatttcctataatataatcttataaatacttagttgaattataatttaatgaataataaagaaactccgggattcaaatcctcggagttttaaaaaattgtaatgattatttatatatacaagtaaaattttaaaatttatcctatatattacagcatatattttaagccagttctatcaatcttatataatttcaaacttaaaaatatattgtaataaaaaaaccctgaattctaataaattcagggtacttaaatacgaacaaataacatttaaaactttaattttaaatataatttataacattactctcttctttcatccagactttactgtcggcttcggaatctaaccgaatctgctttttaaagctcgcgggctgtaccgccgatagggaatttcacccaaccccgaagatttctttatttaatttacaataactatgatatcatgaagttttatctttgtaaagtgattagctaaaatttatgatatcgaattctttcttcttttctttaatccattgaagcatcttaggatcattccaaatgtctaaacctaagctagcatatttcatagcttcttcctcgcttccaaatctaattaaattaggcaaggtacttgaaactcttttttgttttaatatgtatggtataacatgcgggtttctcttatatgctcttcttaaagcactttctgccgctttaatttcattaatcttatataataacgctactctactataatgtatagctgccaaattatctttttcatatttttctagcaggctttttagttgttcatatctctcctcaattaaaagccaattaactactaaacttctaaccactaattcatctttctcatcatactctaggatttctaaagcattctctattgcagcttctttttcaccaatttcccataaatgaatcgctaaactatacttagctccaaaaagttgcctcgctatctttaatctaagaagctctgccggtgcatttttcaaatcatctattcttaataaattcttcgctgcgttaactgctttttctagaagttctgtcctctgattgttatttaaactagaatcttttgataatattatatatgcatccgcacaatcttcatatacttctaatgcttcttttgcatattttgctttatttttataattcttttgtctccatgcatactcaatagttctttgagccattatataatctttatggacagcaaatttaaaaggaacttttgtttcatccttaacagctttatcctcttctattttatcattcatagttaatgcaacttcttctttagcttttagcatagtaccttctgaagcttctgcatccttattttcgcctattatccatttattattatcttttgatatatctaataagctttttacttcctttgatttactagagcctgtactactactaacaccaaactccttatataagtcagcaactttaatatatggcttttcttttgaatcaaataagttatttgcagttcctatagcatgcactattcctgctccccatgaaaagctcttcccctttttaaattgttcttcataattcaaaaataaagtttctgttgctagaacacaaatattcttataatcttcattgagatattcatctgaaaaactctttattttttcaattatttcttcatacttgctagctattccgttagataattcttgcatttcttcttatagctcctttataaaaatctttaacaaatttgactttatcctacaacaattataatttgcaagtatagtcaccaaatttataattttcattttagatttacaatattctctataaaaatattataagttcattacttttttcgtccatattacattataacatattaaatatatttgtatctacttttaaatttttatgaacatttttgttgttttaatctattatctaggctattaccaatcttaatatatatttttctgaaaattttagttcattaaggcatacgaaataaatgaagtgttattttttgattatgcctaaagctcatattaaactatcaatcaggtaatgcaaacaaataattttataaaaaatgaatttattaacacatttctataatttccctcataaacatatttaatgataacaattttaaataaggaaactatatgctaacaaatagtttatataatttatcctttttactatcaatgccttataataatatcaatttaatttctaaacataagtataatttagatgataccatattaaaagaaatttacctaaaaaaattattcaactttgaatgggcaaaaaaattaaactcttcatttaaagactataaatttgattatgcatataatatactagaacaaattccaagttttattaaggttaaactgattctgaagacttcttttattgttaaaacttatcctcaaaatataaattcagtttcaataaatgaatatatactcattttagagtatttgcaagacaaatgcaaaatacaatttatagcagagaatgaagaaaatccacttttatatgaacatatcctaaatactgatttatcaagcctggtaaatagccgtaatttcaataaaaacagcaacataaatgtatataaggataaactttcatcaattgattcattatttgaaatgttcatagcttctagctggctttctactaataaccatgatgaaaaaagagcttccaaatttaatgtcacagatgcctgcgattatgctgaaagattttcattaaattataatcctgaatacaaatcattttctggcatcggaggggattgtactaattttatgtctcaaataattcatgctgggggtttcagtcaaaatgcaacttggaaaccatatactcatgcctggattcgagttgaagaactatatcaatacttaataacgccgaaattagaagccactaagcttccaaacgataaatcattagatagaggctgcttaattcaattttacactccgtctataggacgatattttcataatggctttattacttataggcttcaaaatggtgactgtctttattgctgtcatagttatgacaaattgaattatcctcttagccaaatttatcccaacagatatccaacactcagggccttaaaattcgattgatatacaatatctatctcaaactctagatcatatatagataacccaacactataatctatacttatgcgtataactcaccgaaatgaataatatacttttgttccagtttctggccggaagatacttcatagtttaagtatagtttatgattattatatctataaatctaagtcagatacatgtttacttgaatactacaaaacataattctgaaagcacataaaaagaggttgcattaaggaccagcttgcttcaactttaatcttgcaagctaatccttagcaaccttacttataattaaatcaatttctaataagttaactaagttcgtgaactcaaattataaatttgaactttcatttataacagttagctttcaaatacatattcataaatatgtatctcatttctttgatttatatatatgcttaattttaacgtttatattgttatacagttatctcactcttgatttttaatgcatcttcattattcttaataataggatctacatattcatctataaactcaacaacttgacttggtgctcttccaacaaacttagttggatctataattgctagaatttcttccttagataggccaaatgaatcatcatttattattctatctattaggtcattatctaacccttctccttttactctttgagcagcagccatagagtgcactctaatttgttcatgtaattcttgtctatccttacctcttttcacagcttccatcattatattttcagtagccataaatggtaattctctttgcacgtgagatgctataactttatcatatactaccatgttttcagcaatatttatgtataaatttaacactccatccaatgctaaaaatccttcagctacagatagtctcttgttagctgaatcatctagtgttctttcaaaccactgagttcctgctgtaattgctggatttaatgcatctactattacatatctagctaatgcacttattctttcacttctcataggatttctcttatatgccatagctgatgatcctatttgatttttttcaaatggctcttccatttccttcatattttgaagcaatcttaaatcattactaaatttgtaagcactttgagcaatttccgataatgtatttaatacaatagaatcaagttttcttgggtatgtttggcctgttactccataacttttttcaaatcccattttttctgcaacaatcttatctaaagacttaactttattttcatctccatcaaaaagttccataaaactagcttgagtacctgtagtacccttaacacctctaagctttaatgttgataataaaaagtctatattttcaacatccattactaaatcttgcatccataatgtagctctttttcctactgtagttaattgagctggttgaaaatgtgtaaaacctaatgttggcatgtctttatattctagtgcaaaatttttcaaatgatttagaactgtaactattttatttttaactagatttaaagcatctctcattattataatatctgtattatctccaacataacaagatgtagctcctaaatggataattccctttgcgcttggacattgaagaccatatgcatatacatgactcataacatcatgtctaacttctttttcttttttagcagcctcatcataatttatatcattgatatgttcttttaactcttttatttgttcctcagttatatttaatccgagttctctttctccttctgctaaagctacccataattttctccaagttgtaaacttcatatcatcagaaaaaataaagctcatttcctttgatgcgtatcttgaatttaaaggtgtgctatataaatttctcatctaaaaacctccacacgaatatattttatgctttttcttttaacattcgtattatatcatatttttttcatttttgcctatttaattttagaattatttgttctcttttgtatttaaatttattttacatttttgttattattgtctctaagaatcatatatatatactaaggatcatattaaagattggagtgaagaaatatgtgtaagataggtatcttagataaactttcctttttattagttcttataggttcattaaattggggaacaataggtttgttcaacctaaatatagcaaaattaatttctatgaatattccaataatagagaggtttatctatattgcagtatttttaggtgccttagatttggtttcattgctatttagatgcaatttaataatggatgagaattagactttaattaaagatctgcatgagtaatcgatatcaagaattatacttatataaattatttaatatttatactactaatgcaccaaaaaaggttccatattaataatatggaaccttttttggtatattagtcttctaaagtttgaactaatttaacgatttcttctactgctaaagcttcgtcatctcctgaagcaacaaccttgatagtagcatctttagttactgctaaagataatactccgattaagctttttacatttgctttcttgccgttatattctatactaacgtctgatttaaatgaagaagccttcttaactaataatgttgctggtctagcatgaagaccagatgaattttttactgtaacctcttttgctatcattatatacacctctttacaaaaaattaataaatatagcatttaactattatagtataatcgtttttattgataatttcaacttaaaaatgattgctcatatgataatttagaaataattttaattatctaggttgtactattaattttatggccgttctttcttctccatctatttgtatatctgtgaaagccggtacacatactatatcttttccacttggtgcaacaaatccccttgctattgcaatagccttaactgcttggtttatagcacctgcaccaacagcttgaatttctgcaatatttttttcctttattatagctgctagtgcacctgctacagaattaggatttgattttgttgatacttttaatacttccatttttgttattcctcctagaatttaatacacaaatcgtttacattaaatatattctatataattcctaaaattccttttagaattactaaattaaaaaatatttttatttctaggtattttgtttttatatactcaattatagtttaaatgaattaattacatctaatctataataaaacgaagtatatttcatcacttaacaaaatatacttcactttttttacttagcaaaatctactgctctagtttctcttatgacattaattttaatttgtcctggatattcaagttcttcctcgacacttttaactaaattacgtgccaattcaattgttccagcatcatctactttatctggtttaaccataattctaatctctctaccagcttgaatggcatatgacttttctacaccttcatgtgaatttgcaatttcctctaacttttccaatctcttaatgtatgcttccaatgtctctcttctagcgcctggtctagccgctgatattgcatctgccgcttgaactagtactgcttctaaagattgcatttctacatctgaatgatgtgctgctattgcatttattactaatggcgattcgtgatactttttagctagatctccaccaattagagcatgaggcccttcttgctcttgatccacagctttaccaatatcgtgtagcaatcctgctcttttagctaaagtaacatctaaacctagctctgaagccattaagccagctaagtatgaaacttctatggaatgctttaacacattttgcccataacttgttctatacttcaatctaccaagaagtcttataatttcaggatgtagtccatgtacactagtttcaagagctgcttgctctccttcttcttttatactactttccacgtccttagttgctctttcaaccatctcttcgattctcgctggatgtattctgccatccactattaacttttctagtgccattctcgcaacttctctcctaattggatcaaagctagaaagaatgactgcttctggagtatcatctataatcaaatcaactcctgttaatgtttccaaggttctaatgtttcttccttctctacctattattctacctttcatctcatcattcggtagtgcaacaacgtgtacagttgattcagacacatgatcggcagcacatctttggatcgcagttgtaattacttcccttgctctcttgtctgcctcttcttttgccttactttcaatatcttttatcattaaagctgcatcgtgcgtaatttctttccttatttcatctagaagaatctcacgtgcttcttcactagatagagccgatattctttcaagttctgctcttctttcttcataaagcttctgtactcttgcttctacttgatctacctcaagcattctttgattgattgtttcgtctttcttttcaagaagttcactctttttatcaagtgcttcttctctttgaattactcttctttcaagcctttgaatctcatttcttctctcacgagattccttatcaaaatcatttcttaatttatgaagttcttctttcgcctcaaggattgcttcttttttagttgcttctgcatcctttttagctcttactagaatttcttctgcttctttttcaagcgattcaatctttgcttttgatatgttttgaatcgttttataaaccactattcctaatattaataaaactattacatctattaatatcattactgctgttaccacataaacacctcctaatttatcattttctcattatattattaacaagaaagtatagtaggtgtcatattcttctcactgcatttggaatatgataaaccagtattcctttttattctatattaaaaacaaaattatgtcaagtttgcgcatataactgttacatactgcattatgctgttaaatacttaatatagctgcatatatatgagttatcataatatatgcagctatacatttattaataaatattatgaagtaaattcacatttaaactttccatttattgcatcttctttattcttttgtatctacagcaacatcatctttagcgcttatattttctttagctccctctggtgcagctgccttaaatagttctgcaggtggaagattatacttttctctaatttgattttctatatctaatgccacttcaggattttcttttagatataacttagcattttctcttccttgacctaatcttatatctccataagagaaccaagcgccactcttttgaacaatctcttcttttactccaacatctactatattaccacatcttgatataccctcattatacataatatcaaattctgcttgtttaaatggtggtgcaactttatttttcattacctttattcttgttctgttacctattattgaatccccttgttttatagaatctattcttctaatatcaagtctcactgatgcatagaattttaatgctcttcctccagttgttgtttctggtgaaccaaacataaccccaactttttctcttaattggttaataaatatagcaacacaattagtcttatttattgttcctgcaagctttcttaacgcctgtgacataagtcttgcttgaagaccaatatgtgaatctcccatttctccttcaatttcagctttaggtactaaagccgcaactgagtctactaccaaaacatcaatagctccagaacggactaatgcttcagctatttcaagtccttgttcccctgtatcaggttgagaaattattaagctatctacatcaactccaagtttttgggcataactaggatctaatgcatgttctgcatctatgtatcctactgctccacctttcttttgtgattctgccgctatatgaagcgcaattgtagtttttcctgaactttctggtccataaatttcaataattctacctttaggtactcctccaattccaagagctatatctaaatctaaacatcctgttgatatagcatccatgttagaaatattgtgatcacccaatttcattactgatcctttaccaaattgtttttctatatgactcatagcactttcaattgcttttaatttttctgcatttataattcccataatactaattaactcccttccatcgaacttatgttctatatttattataaattaattacaaaccatagtcaataattaattctaagaaaagccccttctttgctagcaaagaaggaacctttttaattcatatccatttttttatatttctaaacatggatcttatatattttatttatcgtaagaaacagcttccttattctttttaaagtaatcgtaacctgaaagcagggttactataaccgcaatcataagcattatcattggagcgaatttaaaaaatcctttcaaataataattgtctattacaaaaatttttaacagccttgcatcatgaatgttcacttttaataataataaaattattgctataatttgtataaccgttttaatttttccccaccagctagctgctataactcttccttgcgctgccgctatcgatcttaaacctgaaacagcaaattctcgtgcaattataactacggctgcccatcctggtactacctgtaaatcaactaaagaaattaacgccgcagtaactaataatttatctgctaaaggatccataaatttcccaaagttagttatttgatttctagatctagcaatatacccatctaacttatccgttaatgaagctaaaataaatataaatgtagcaataaaacttccatatggtatatctttaactgctataaatactaaaaatacaggaaccaaaaatattctaattaaggttaacttatttgcaagattcatcaacaacaactcccactaaatcataatccatagtctctactatttttacctttacaaattcaccattttctatttttgcatttgattcaaataatacatttgcatctatatcaggagccatttcatagcttcttccataatagcactttccattatatccctcaacaagaatatcatataactttccaattttcaatttatttatttcttctgaaatattcttttgtaaaagcattaaatcttcttctcttttttccttaatttcttcatctatttgcccatccattttagcagctggagtatcttcttcctgagaataagtaaatgcacctactttctcaagcttatattcctttaagaaatcaataatttcattaaaatcttcatcagtttcgtttggaaatcctactataaatgttgttcttataacaatttcaggaactctttctcttaaaatttgtattttattaattatatcttttttactagtttttcttcccataagttttaaaatcttatcgcttatatgttgaataggtatatctaaatactttacaactttttcattgcaagcaatttcgtttataagttcatcatatatctcttctggataacaataaagcacccttatccattcaattccttcaattttggataattccttaagaagaacatgcagattctttttcccataaatatcgcttccatataaagtagtgtcttgagctataagtataatttcctttactccgctctcactcaaatctcttgcttcatttataatattttccatcttcctacttctaaattttccccttatcttaggaattatacaatatgtgcaaaaattattgcatccttctgctattcttatatatgcactctccctttgagttgtaataattctctttccttcattaatgttttcatcggaataatttaaaagttctgttgctaatttatttccatctataaattcagttatgatttcatttattttattatagtcattaactccaagcattatatctatttcaggtattaatgtcttcaactcttctccatatctttgagtaagacaccctgtagctataagcagtttgcatttataattaattttataattagccatctctaaaattgtgtcaatagattcttgtttggcactctctataaatccgcatgtattcactataattatatctgcgttcttggggttattagttatctcatattcatcactcatcttacctaatattatctctgagtcaactctatttttatcacagcctaagcttaccattccaactttatacttgcttgaagcctcttcattatattgttctctattcttcgctatttctattttaatttcgctcaacttcttatatcctcctacgttctaatagtcttaattataacaaattagaactacattttacaagttgctattatacatatactactcccaaatctcataaaaatcacttattattttacctcaaaagagttaaattaaaaaagttaacataatgtttaattttatttcataattaatctaaaactatagctttaaactttttagacattattaattaattttcctcttcatgttcatcttctaatagctgctgcttagtaataagcacctgccttggtctacttccatccttttccgatataatcccccgttcttctaattgatccattattctagaagctctattaaaccctattctgaactttctttgaataaacgaagttgatgcttgaccatactcaactacaacatttatcacctcattaagtaattcatcaacatcttcattactatcatttgcatccacagattttgaatctgacgcattattaatatgatcaattatatcttcttcatacttagtatcaccctgttcactcttaataaacgatacaacttgctctacttcttcttctgatatgaagcagccttgaactctaagaggcttactttctcccactggataatataacatgtcaccttttcctaacaatttttccgctccggatccatctaagatagttctagaatcaatttgagatgatactgcaaatgatattctagatggaatattagctttaattacccctgttattacatcaactgatggtctttgagttgctataactaaatgcatacctgcagctcttgccatttgtgctaatcttccaatataatcttctacatcattaggacataccatcataagatcagcaagctcatctactataataactatatatggcagtttttgttctattatacccttattaaataattcattatacgactccatatttctaactccagagtctgcaaagagcttatacctattggtcatttcatttactgcccaatttaaagctgctgccgctttcttaggatctgtaacaactggaatcaaaagatgtggtattccattataaacatttaactcaacaacctttgggtctaccattaaaagtttaacttcttctggattatacttatataataggcttattataagagagtttatgcatacactcttaccagaacctgttgcccctgcaatcagtgtatgtggcatcttactcaaatctcccacaacacattttcctgatatatcttttcctaaagcaaatgcaagctttttcttagactcgataaattcatcattttctagaacttctcttaaaaagactggtttttgttttccatttggaacttctataccaactgccgccttacctggaattggtgcttctattcttatcccagaagctgctaaccctaaagctatatcatcagatagatttacaatcttactaactttgacgcccggacttggctgaagttcaaatctcgtaactgatggaccttttgtaacttgagtaaccttggcatctactccaaaattagataatatttcttcaagcttattagcattctctattaattcttttttgtcactgctattaagttttgtatttgaatttaattttaataattcaaggctcggatgtttatactccttagtttctttttgttccattatatgttcttgtatctctttatttactacttccttaacatcattacctaagttttctttcttcttagtatgactttgcgtaggtttttctataaaactctctatctgaatatctgatgatacttcagcttttgatataggtgagatttctgtatcatcactagtatttttcataaaatctagaatttttatcttcttttctacaccagaaagaaatgcttctttttcattttctttatcatctttttctactatatttataaagttctctctaactggtttctgctcatcccttacttttctacttcttctgctatttcttattttttcacctttattgtaggcctttatccctaaatcataaagagtaatatcgaaaatcaaagtgatggcaattattgaaaatgcgagaagaactatatatgtcccaagggcccctataattttatacattggataacatatgagatatgccattattccaccatgaggagtctgggcgctatcattaagtatgaccttaaaattttcaaaaaaacttccttgcccgtctaaactttgaatgtttattgttccaaatgtcaatatggtaacagctactaatatagttattccaaaaaaattcttgcttaatttaatatttcctcgtgtttttatatattggaatccaaaatatattaaataaataggcaatgcatttgcacctattccaattactacatatgatactctttgcgctaaagatgataatattccagctaaagaagtgtatattgctataccaagtattattcctgttgcaatatacactattcctactatatctggatttattgtgttttcatcttttttactttttgtagtgctatgtttgcctttagtcctacccaccttaaatcacctcataattttatttctacattgaatagcaattctcctttaataagataacactaaaaacaaaaatcggctatagatttttttctataaccttaaaaatagctactatttttctattaattcattaagtttgcttaaagcttcctgtattcctccaacttggtcaataagtccacaatcaactgcttgctttccaattaacattgttcctacatcatttaataaatcatctgtttgaagcatgaatctttctaaagtatctggttttatatttgatgttctaactataaactcatttattctttcttgcattttcttaaagtattcaaatgtttgagataccccaatcacaaatccattcattcttactggatgaactatcattgttgcagatggtgttataaatgaaaagtctgctgatgtagcaagcggtactcctatggaatgacctccaccaattactatggaaacggttggttttgacatacttcgaatcatttcagaaatagctaaaccagcttctacatctcctccaactgtatttaagactataagaagcccttttgcatcatcattttgctcaatatctattaattgaggtataatgtgttcatattttgtggcttttgtttgtgggggaagtacggaatgcccttcaatctgccctattatagataaaacctgtattcttttatttggagttgctaatgtagtatttccaagttcttttacattttctattttatcctgtgcttctgatgtatttttatcttccttttctttctcattattatttaaaatatatttatccataaaataattcctcctatactctttttattttgtacagtaggaattattttatacataagtgaaattccaaatctatgatttggctaattgaacttactcagcgaacgaagcgagtcgagtttccttttaaattcaaaatctatgatttagttactcgaacttacccaactagccaattttccttttgaatcccaaatctattattttattaatttaacttactctatataaaaactcatagaacgcatttaattaaacttcctttatattaaagtttaaaagttttatgtaaaacatttattgcttctttttcgttttcagagtgaaccaagcaccagattgtcatatgagaatctgctgtttgtagtacttctatattattatcacttaatgccttgattattttagccattactcctggtattcccttcattctagaaccaataaccgctactttgctacagttgtctatcaaagtatactttaagctagcactatttagaacattttctaaaatctctttatccacttgatttatagtgaaaatttgttcattaggaaatatatttattagatctaagcttattttatttgcagctaataaatccaatacatttttgtattttacatttccttgattttctgctgcccttatagaaacctgaattctattcttttggcttgcgattcctgtcattatcctgtcattgcttttatctccaaagttgtttattaaagttcctttactattactcatagtatttttaattaatataggaatatttccttccattgcaacttctacggcttttggatgaattactgttgcacccttatccgctagttggaatacttcattataacttattacatcaattaaatttgcattttcaacaactcttggatctgctgtcatgattccatctacatcagtatatatttcaatttctgacgctttaagggccactcctaaaatagaagccgtcgtatcgcttccccctctgcctaaagtagttaaatatccgttttcagtcattccttgaaatccagttactacaggaattcttccttgagacactaactctagtatttttttaggtttcacctcaatacaagttgcatcagtaaaattattatcagttaatattcctgcttgtccgccagtaagtggtacagcatcaattcctgcattatataaatcattactcataacaactgagcttataatttctccacatgtcattaataagtcttgtgctaacttattagcatttttaaatttatcgcttattaatgataataatgtatctgttgcatatggctgaccttttcttcccattgctgatactaccacaacaggactatatccatctttaatggcactcttaactttttcaattactttctttctattttcttcagtagatactgaagttcctccaaacttttgtacaactattttcattaaatttcctcctgaattataactttactttttttattacttcctcatctgcatctaatatgatagttttagcaccaattttttttacacaatcccatggaatttctaaaaaatctttactgctaaatagattaaatttcccaccacttaaattaactattaaatatttaaaatttccttcttcatctattattagatcattattcaatagataatcatatttttcaccatcatttatattaataagttcgtatctctctatgtcacttaaatatttcaccttattttcttcgctcataataaaaacctccttttagtactcataaaataatatgagaaaaggaggtgtattattacataatcttctataaattaattttaccattatggtttgagttatcatatgctttggcattctttagtattatagaatctaatttactatattctacatcttgcccaacatacgctgcatttataactccctttttaaaacatctttctaagacgtattgtatattatcttttcttatattatctattttctttattacttcttcttgagtttttattttatttctaaacaggaatgtctttgcattagaaaacattcttgaactcgtactttcaagccctaaaatataattagctttaattttctccttgtttatttcaagctgcttatcagttattccattcttactaaatagagtaatttccttttctacaacctctaaggccttctctccataatttctatttaagccggcatatatatttaaagttccaactccctgaaatggttgcaagtaagatgttatagaataacataatcctaattcttctcgcactttttggaaaaggattgaagatgcaccacttccaaatatattattaagtagcactaatgcgtaattgttttcatctccataaggtaatccctctaatcccagtgaaatatgaagctgctcgatttctttttttgcatatgcagaatcaacttgtattattgttttatcatattctggagtatattcacctttgcttttccattcaccaaaatatttattaatcaattcatctaactctttatcattgaatttaccacaaactgatattacagaattatatggcgtatacttttcactaataaaatttaatatcttttctctagtaaatgactttaccaatggtattgttcctaaaataggatatcctaacgactcatttccaaaacaagctttagaatgcacatcatctaatacatcttccggcgaatcttcactcatattaatttcttcaattactacgcctttttctttttctatctcttctggatcgaattttgcatttaaaagtatgtctgaaagaacatctaacgttaaatctagatgggtatctaatgctttaatataataacaggtagcttctttacttgtgaaagcattgatctgtcctccaacattctcaatatcctccattatttctttagaagttcttttatcagttcctttaaaaaacatatgctcaataaaatgggatattccattaacttctggactctcatttctagaaccattctgaaccattactccaacactgatagaatttaagtgttctattttttctgttacaattcttaatccatttttaagggtatatgtgttatacattttgtacttgccctccttcttagttaaaaaaaaggcaattaattgccctttatttctcttccttattttcttgttctactaaagcatcttttcttgaaagatttattctgccttggttatcaatttctgtaaccttaactaaaatctcatctccaatagatactacatcttctactttgttcactctttccttagctagcttagaaatatgaactaatccttctttacttggtaaaatctcaacaaaagctccaaatgtagttattttagtaacttttccaagataaacttctccagctttaacttctttagttaatccttctattatctttatggcttcattaacaccattatgatcagttgagcttacaaatacagttccatcttcttttatatctatcttaactcctgtatcttgtataattttatttataaccttaccacctgctcctattacatcccttatcttatcaggatttatgctcataatttgtgtttttggagcatataatgaaacatcttctttaggtgtagaaatacattcgtttattttatcaattatagtaagtctagcttttctagcatctcttatagcattttctactacattaaaactaaaaccttgaagcttagtatctacttgaatagatgttataccttctgttgttccagctaccttaaaatccatatctccaaagaaatcttctattccttgaatatcagttaatactgcttcttcacttaaatcttctgaagttattaatcccattgcaataccagctgctggtcttttaattggtacacctgcatctaataatgctaatgtcgaaccacaaactgatgcttgtgaagttgaaccattagaacttaaaacttctgatactaatcttattgtatatgggaattcttcttcggaagggattaatggttctaaagctctttctgctaaagctccatgacctatttcacgtctaccaggacctcttaaaggttttacttctccaacactgtatcctgggaaattataatgatgcatatatcgttttgattgagcttcatctattccatctagaatttgaatctcgctaattgagccaagagttgcaactgtcattacttgagttaatcctcttgtgaataatcctgtaccgtgtgttctaggtaaaattcctatttcacatcctaatggtctgatttgatcaaatgctcttccatctggccttctcttatcttttagaagcatgtgtcttacaactttcttttgcatagtgtaaagaacttccttaatatcgcccattttatcagcatatttttcaccaaatgcttcattaactttttcataaactgcatcaacagcagcatttctttcatctttttccatgatatacattgcttctttaatcatgtcagatgcaaattctttaacatctttttcaagttctggatctacagcatataatactggttcatcttttttctttccaaacttagctactgcttcttcttggaatgcaataatcttttgacactcatcaaaaccatatttaatagcgtctatcatagtatcttctggtatctcctgtccaccagcttcaatcatcattactctttcttttgtagcgcatactgttaaatgaagaatgcttttttcacgaccttgagtatctggatttgtaacgaatttaccatcgataattcctacttgaactgctgcagctggaattgtataaggaatacttgaaaggcataatgcaagcgatgctgcattaattgctaagatttctggcaaattatctttttctacggatacaactgtagtaacaacttgaacgtcatttctgtatccctttggaaatagaggtcttagagttctatcaacagctctaccatttaatatagctttttctgatggtcttccttctctcttgataaatccacctggaattttacctactgcatataatctttcttcatattcaacacttagaggaaagaaatcaattccttctcttggctgctctgatgcattaacattagttaaaattactgtgtctccatagctagtaaatgttgctgcatttgataacatacctacttttccgaactcaactttcaattctcttccagcgatttcagtcgttagaacgttattcataatttatgacctccctttaggttcatctaatcattaataatattgtataatttttctataatttgtatagtttaaaataatagagcggaaaactccgctctaaaaattatcttcttaaacctaattctttgattaaagttctatatctttcgatatcttgatcacttaaatagtttaaaagacctcttctttgaccaaccatcattaatagacctcttcttgagtgatgatctttcttatgaacttttaaatgttcagttaaagattgaattctttcagtaagtaatgctacttgaacttctggtgaaccagtgtcgccttcgcttcttccaaactttttaattaattctaattttcttgccttatccattataagtgcacctccgtgtattatattaattatcccctagttccaagtaaaagatggcaccttacaacttagaattaggttccctgtgttattatatcaaaagtaactattattgtaaactatattattaaagccgacatgcaattctcattttttgcaaaagctttatcactttcgagctggtcctttaattcttctaaactattaaatttttcttcgtcgcggattttttttataaaactcacatctattttatctccatatatttctttattaaaatctaatatataagtttctaccgttaaatttttaccttcaaccgtaggattgtatccaacagatgtgattcctttatatatattattatttaccttaacattagtataatatacaccaatcttaggtaaaatgaaattttcatcatattttaaattcgctgtaggaaaacctatagttcttccaattttctttccatgaataatttcaccacttaatgtgtaaggcatgctgagcatcttattagcttctgaaacctcaccatcttgaatggcttttctaattctagtactgcttacaacatcgttattatatgtacgtggatccataacatatagttcatacccatattcattttgcaattctcttagaagttctacatttcctaaattcttatatccgaatttataattaaaccctacaacaaaccccttgatattataattaactatcaaaaactctataaattcctttggtgtcattttcataaattcaagatcaaattccttaaagcaaactatatctactttatgtttttccagaatttttgcttttctttcattgtccatcaaaagttttactgagttttctttatttataagagttcttggatggtttttaaatgtaaaaaccatacttctccctttatttttttttgcaacttctactactttatttattaaagaaagatgcccaatatgaagtccatcaaaacttccaagagctatataattattagaactttgaatatcttttgaatgtttatctataattatcattatccttactcctaaatcaaggcacccagaaaaacagctacatactagttaagatgcctaaagcaacaatttttcgattttgaatccatcatcatcttgttttccaattcctataaaaatgccttcactatcatataccctatatagaacatttttttctcttttttcatttgtcaatctcttatcgaatactttaactccatttattaataatttagtaaatgtactctttactgtaattttagggtaaaaagaaagtgcatcctctatggtcataatataatcttgtatattttccttagttaaatcatctatgtttacactatctgattgcttaaaaatagatgtttcagttctattcaattctgccatagctgctccaacttttagtttttcaccaatatcataacataaacttctaatatatgtcccttttgaacaagctactttcatatatacataaggtaattcaatcttcaaatctgatatattaaatattctaacttttctcgcttctctttcaacctcaatacctttcctagccaattcatagagccttactccattttttttaagggcagaatacataggtggaacttggtcatattctccgataaaggataatgcgacctctgaaacttcatcactcttaatatgatctatttcattcttctccaatatctcaccttcaaggtcatatgtggttgtcttcactccaagtagaaatttcacctcatataccttattactgttcatgatataatcaatagtttttgtagcttttccaaggcatactggaaggactccagtagcttctgggtccaatgttccagtatgaccgactttcttttcgttagccaagaattttatttttctaaccacatcaaaggaagtcattcctttatttttgaatatatttaatactccatttatctgtgaagtttttgtatctttcatatatgaattctctattccttccttatataagtgaagttattacttacttttcgtaaatataatttatattttatgagtcgagctcttctttaagtatctttagcagattttcttttgcagtttctatatctacacctttttgcataactccagcagcttttatatgcccgccaccgccatatacttctgcaacttttcgaacatccacatcatttttagatcttaagcttcctttaactccatcttcaacttctttcaaaagcatagaaacttctacacctttaattccaaggccaactgaaattatatctgaagtatcagtattttttaagttaaattcctctaacattcccttcggtatctcaaggactgctactttattttctagagcgagctcaatattagataacacacatcccattaattttactttctcaaatggtttattatcaaaaagattactatggactttactgttgtttactccaagttctataagttctgatactattttatgagttctcttagtaacattggaatgcctaaaagaacctgtatctgttacaatccctgtataaactgcgttccctatatttatttcaacatcagttttattattaaaatcaattcctaactcttttgctagtaaatatgatatttcacatgtagccgctgcacttacatcaacataatttataaatccatattcttcatttgaaatatgatgatcaatattaataatcttacctttgtaattacttagatctgcagaaattctttcaacattaccacaatccaatatcattacaagatcagtgccctctttaggctctaaagtattaccatcaatttcgttggcaaaagaaaggaaagagaggttatcagaaataacatctcttgatataatatatgaatcctttcctaaatgtcttaatgcatttagtaatgctaaagtgctgcctatagcatctccatctggagatgtatggaatgataatccaattctttttgattttaaaatttcttcttttatttctttaagactactcattgcccttacttatcctttgaattaattcatccatatgcataccgtaatttatagagtcatctaattcaataattatttctggtgtgtgccttaaatttattttttggcctactgatttccttataaatccacttgcattttttaatgcctctagattatttttcttttcctcatcatctttagagaatatacttacataaaccttagcatatcttaaatcttttgtaactttaacatctgtaactgaaatcatagctgtaagtcttggatctttaacttcattttgaattaaattactaatttctcttttaaattcttcgttaattcttccacctctatagtttgccatgttgatcttcacctcttttaaagttcttttctcttaattgcctccatcatgaagcattcaacgatgtcaccttctttaatatcgttaaacttttcaattgttaaaccacattcgtatcctgcattaacttcttttgcatcatctttaaatctctttaatgatgacaatgcagattcaaatattactattccatctcttataactcttgtctctgcatttctttgaagtttaccctttagcacataacaaccagcaattgttcctacatttgaaattttataagtttctcttacttctgctgttcctaatataacttccttataatctggttcaagcattcctatcattgctgacttaacatcatcaattgcatcatatataattctataagatttaatatctactccatctctatcagcttgagcagccgcattgttgtcaggtcttacattaaatcctataactattgcattagatgctgtcgcaagagttatatctgtttcagttatagctccaacaccaccatgaataactcttacctttacatcatcagtagaaagtttttctaaagattgctttatagcttcaacagaaccttgaacatctgcttttacgattatagcaagctctttaaccttaccttctttaatttgattatataaatcttctaatgatactctatggttagcaagtaaagtttctgcttttaatttgtcttttctgctttcagccatatttctagcagttttttcatcttttacttgattaaatctatctccagcttctggaacttcagaaagtcctagaacctccactggtatagatggtccagcagattttatttttttaccagtatcatcaaacatagcccttattctaccatatgtagatccgactaatatagaatctcctactcttaaagttccattttgaactaaaagactagcaactgctcctctacctttatctaatttagcttctataacagttccaactgctcttctatctttgtttgctttaagttcaagcatttctgcagtaagtagaaccatctctaataacttatcaatattaaggttttgtttcgcagatacttcttcacatatagtatctccaccccagtcttctgcaagcaatccttgttcagctaattcttgcttaactctatctacatttgctcctggtttatctattttatttattgcaacaacaataggaactcctgctgctttacagtgattgatagcttccttagtttgtggcatgattccatcatctgcagcaacaactaatataacaacatctgtaatttgtgcacctctagctctcatagctgtaaacgcttcatgacctggagtatctaagaatgttatttcttctccgttcaatttaatagtataagcacctatatgctgagttataccacctgcttctgtatcagtaacttttgcttttcttatacaatcaagtaaagatgttttaccatggtcaacatgacccataacagttacaattggtggtctcttttgaagattttcttcatcatcttcttctatttttaatacttctaactcttgaatttcttcttttctttcaactaaaactccatattcagcacaaaccttttctgcagtttcaaaatctatttccgcatttattgctgccataactccggcaaaaattaacgttcttattacatcatttgaaggttgttgcaatttttctgccaattccttaacagttatgcttccaccaatttcaattactttaccttcagcctctgcttcagcagctattcttgcttcttcttgttcttcttttttagtctttttctttttctttatacctttgttaagttgttctgctaattcatcttcatatacgtcaactatgctttttgaattctcagcattatcagccgatgctactaaatcgcttggtgattttcctgctaataattcttttattaattcagcatcttcgtcttcaattgtactcatatgattttttacttctatattaaattcttcctttaatatagttattaattcctttgactctatgtttaattcttttgctaattcatgtactcttatttttgacatgcagtcacccccgtattattatctactcatatatttttttcctcctcatataacgctaacagtctttttgctatatcgttatctagaattcccagcaacataatttctttacgtccaattggaggtcctagttgttcttttgagaagtcttcaatatatggtatatttttttcattacaatgctttttaaatttatctttagatttatctgataaatcattagatatgataaaaagataaattttagtattatttctatagtcatcacacttgctatatccttcaagcaagtttcctgacttctttgccatacttagaaagttaaaaaacttattcattatttacttcatcctttagtttattataaatttcttcacttataggaatttctaaatttctactaagtctttttgctttaaatgctttttctaagcactctgtgttcttacaaatgtatgcgcctcttcctgattttttaccagtcagatcaacacacacctcgccttctggagttttaactactcttattaattcttttttttgtttcatttccatgcaaccagtgcacattcttaaaggaattttcttaaccttcatgaaaagcacccctctattcttgtatttcttccattgaagtttcttcatctattgaatcatcaacttcaatatcatcaaaaatttctaattcatttaaatctgtagtttgttcattttcaatttctacttcagtatttagaattctttcatcttcttcatcttgcgcttctttttgagatttactctttatatctatcttccaatttgtaagtttagccgcaagtcttacattttggccttctttacctattgcaagcgataactgattatcatcaacaacaacctttgcagatttattattttcatcaaccgctacacttagcacctttgcaggacttaaagaattagctataaattcttctggatttttgctccattttattatatctattttttcattcttaagttcattaactatactttgtactcttactccttttggtcctacacaagcgcccattggatctacttcttcatcgttagagtatacagctattttacttcttgaacctgcttctcttgaaatacttttaatttcaactacgccttcaaatatttctggaacttcaagttcaaatagtcttttaactaatccaggatgtgttcttgatacatgtatttgaggtcctttattaccatttttaacttcaactatatatagttttaacttttcgttgaatttatattcctcatttggaatttgttcattaggtcctattataccttccaattttcccaaatttacaaaaacaatacctttatcttttcttaatatagttcctgtaattatatcaaattctttttctttgtattcatcatatattatagttctttcagcttccttaattctttgagtaacaacctgcttagcaagttgtgctgcaactcttccgaaatttttaggagttacttctaaacttataatatcatcaacttcacttttaggatttaattctttagcttcttctaatgaaatttctgttacatcatcatatacctcatcaactactgtcttttgagcatatacatgtatttctcctgtttctctatcgatattaactttcacgttttgtgcatttgtattggcatttgcataatttttcttatatgctgcaaccatcgcgtcttgaatagttgtaaaaagtaaatcttcacaaatccccttttccttaactaattctttaagagcacctacaaactcttcattcatttttataccctcctcgttatatttccccttctaaatttgctgccttaattttatctcttggtatttgaatttctgtctcgccttctactaatatagaatcttctgagacatctcttaataatccttttacacttttcactccatttagtgaactagtaagcctaattagcacttcgcttcctatgtactttttaaaatgctcttctttatataatcccctattaagacctggcgaagaaacttctaaataatatgcttctttaattgggtcttccacatctagaatctcactaactcttcttgaaaccgcttcacaatcatttaatgatactctgccttctttatctatatatattcttaagtaaaactcaccgttttccttaacatattctacataatataattcacatgacaattctgaaacaataggtcttactaattcttcaattctttcaatcaatacatcttttttcatctttctaaccctcactttcatcttttaaaaacacatgtcttatatctatcttatgcatttttaaaatttgtaatcaaaaacgcaactatcttaagttagttgcgttacaaacagaaagagcgggtaacttcccactccttttttctagctattagaaataaatcttcttatataatatcataaacaaattaactttacaagggatattcccaaattttaaatatctgctcaatattttaatgcatagttcataattcacaattttaaaatacattttatagacatatacattattatatatacttagctccgcgattcttcaatctgcgaaaacatccctaatttaatttcgtgcctttttcatctgtgaaatgttcttaattgtgctccgtgcttttttcatctgtgaaatgttcttatttgcactccgtgcttttttcatctgcgagttgttcttaattgtgctccgcaccatcttcatctgtgcataatttttctatttcttccattagggcatcaataagatcttcttcctttactttctttatgatttcgccttttttaaaaattattccttctccttttccgccagcaatcccaatatcagattccctagcctctccaggcccatttacaacgcatcccataacagcaactttaatatcttttttataattttcaagccttttttcaacttcttctgcaatttttatcaagtttatttgtgttctgccacaagtaggacaagatacgaattcaacgccttttttccttaatcccaatgcttttaaaatttcaattccaacctttatttcttcaattggatcagtggttaatgatacccttatagtatcacctattccttctgcaagaagcgtccctattcctatacttgatttaattgtccctctttgaatagttccagcttctgtcactcctaaatgaagaggataatcacatttttctgctatcaatctataacattctatcatcatttgtacactagatgattttatagatatcacaatatcgtgaaagtctaaatcctctaaaattttaacatgtcttaaagcgctttcaaccaaaccctctgccgttggcatgccatacttttctagaatatctttttctagagatccagagttaacaccaattcttattggtatctttttctcactacaagcttctttaagtatttttattctatctacacttcctatattaccaggatttattctaagagctgaaacaccattttctattgcttttagcgctaatttataatcaaaatgtatatctgcaactactggtattggagatctttttgtaatttcccctagactttctgcatcttccatatccaaaactgcgcatcttatgatatcgcatccagcgctatatagcttttctatttgattcaaagtattttccacatctttagtacgagtatttgtcattgattgtactgtgacaggtgagtcccctccaacaaatacatttccaactttgacttttctagattttcttctttccatacaatgtatctcctctaattataattaatctaaaatataaacattatatatatattgcaaaaataattcttcaacataattctaaaaatattgcaagaattctagccgtaattgtgaattgtgcattgtgaattgaagcatatatatttttgcatatttctcttttatcaaaatatttctaatactatttttttaatatttgtcttataattcttataaattgtacattattaaaattatgtatagtaagtttaatactttaaacttaggaaacttgcattcatataagaatcacttcaaatctgaatgcaagttttttatagttataaaatcattttttattcttagaactttacagggaacaatatatcttttattgttactaatatcatcaaacctataagtgcagcaaatcctatataatttaaaactccaactattttatccggaacctttcttctagttattaactctataagtaatatcacacaccagcctccatctaaagctgggaaaggtaaaagattaaaaacagctaaattaacacttaaaaaagcagtaaagtaaagtagcggccaaattccagctttagcagtttctgccgaaatcttaactattgtaagtggaccacctacatcagtttttagattagccttacctgtgaatatcatctctaaacctttaaaagtttgagaaactaacgaagctgtctgattaaagctctgcttaaaactctctgaatatcctggattttgaattctttcaaaattaagccctattaataattgtccttgttcattcttcattggcgttaccgtaacgtccttcttttctccatttctttcaatagaaatatctactggatttccatttgctaatactattccagccgaaatattatcgtatgagaaagctctcattccatttactttcacgattttatctcctggtaaaatcccagcttctgaggctggtgaatctggagtaactccagtcggaatcttatttgtgtacccaaacgcatgtataaagaaagtaaaaataactatcgctaatacataattcataaatacaccagcaattattatgcttattcttcttaatggagattttgctgaaaaacttctttcgtcttcaacactttcttcctctcccatcatttttacatatccacctattggaaataacctcaaagaatattgtgtttcttttccttggttagaaaagattttcggtcccattccaattgaaaattcttctactcttaccccattaagtttagctaatgtaaaatgtccaagctcgtgaactattatcaagactccaaatgctaatatagccaaaattatatacatattaaatttttccctccttaaagtaccgcattttttattacatattccttaacttctttatctaactcaataatgttttctagggttaattctttatttgcctgagttttaaatacttccatgcatctttctattatgtcagctatttgtaaaaattttatctttctatctaaaaacaactctaccgctgcttcatttgctccatttaaaatagttggcataagtctacctgcttttccagctttaaacgctaaatttaaagctttaaaagtatctatatcaggtttttcaaatgttaattgagatatttcataaaaatctattgtatctgcaatacgcttttccctattttcgtaaagtagagcatattgtattggtaatctcatatcctgtgctccaagttgtgcaactatacttccatcattatattctaccatcgaatgcacaatactttgtggatgaactacgacctgtatattatcataatcacagttaaaaagccaatgtgcttctatcacttcaagtcctttattcataagtgtcgcagaatctatggaaatttttctccccatattccattttggatgtttcagtgcatcttccacctttatatcttcaagactttctaaagttcttcctctaaaaggtcctcctgaagcagttaaaattatttttctcaaagtatttatatcattcccccttaagcattgaaatatagcactgtgttccgaatcgactggaaatatttttacattgttctctttggcagctttcatcacaatttcgcctgctacaaccaaagtttccttattggcaagagcaatgtctttttttgcctctatagctttcatagtcggctctaatcctatcattccaactacagaagttactaccatatcaatttcatctaaagatgctatcttatcaagtccttctatcccttccaatactttaatctttttattatgctcttcacaatacttttttatttcgtgagtacttacagcatccatcatacctacataagaaggtttgaactcttcaattatctcaataactttttttacagatgtgttcgccgttactcctataagctttagttctccatttgattttcttattacatctaaggtctgagatcctatcgaacctgtagcccctagtatagaaatgtttttcattctttttcctcctaaaagcaaatcttaatcagtactgctcaaggtttaattcgaagattaaaagtctcttaattaactttaaataaattatttaaatcaaaataaaattccttattcttcataatcactcagtactataaattatttcttttgctagaatgctatacattgggccaattaatatacctaaaacaccaaatatttttactcctatgtatatagataacaatataacaagaggatgcatatctaatttgtcgcctaaaaatttagcctctagtatttccctaataacttgcactagtatatatagacatataagaccaaatgcagtaaggaaattcttcattataatattgtatattataatcggaataaatacaattatagttccaacatatggtaatatatccaatatcccacacactataccaagggcaaaaaaattcgatactccaagtatgcaaaatcccattattatctccatagttgaaattataactaagatcccttctattccaatcatttgagtaaaattttctttttgatctctaaatttcatcatcatttcctttggaagtaacatagaaattagttctaaaatttttgacttatcaatcaatataaagaaagcacatatgtttcctataaagtaagctaaaacactatctccagtatttactgctcccttccttatattctgatcattaattatggatattacgctctttccaatttccaagttattaaaatttacatttaatgcaactgaaatatcttgaataaatttttctatccattctaaatttgttaggtataatttttttattatataaaaaatttcacttcccaaatatattgtcacaagtattatgataatattgacagtaacaatacttaaagcacccgcaattttacttggcattttagccttaatcatgattttgtatataggagcgcatactataattattataatcatggataaaaacggcttaaaatagtattttataaaaaaggttcctattaatacaaatacgaaagacaataaaagtgagaaaagtttcttataagttttaaaaatattcttcacctcactaacttaataattattaatatttgtatattatatgccaatcatctcttgttaaaaacttcataacttaacttatataaaaaaaattaagccttatataagttatactatataacgcttaatttctctctaatttttaaattcttattataaaagttaagtaataaaacactgctgctgctgcaaaaattatactatcaaatctatctagaactcctccatgaccaggaattaggttactataatcttttactcctacatatctttttattgatgatgcaaccaaatctcccaattgtccaaataatccgcataaaataccgataatgaaataattatatattggcataatattaacatatctttgcactactattccaaatatacctgtaaaaacagttgctcctacaagacctcctattgaaccctctatggttttcttaggtgacactttaggcgaaagtttgtgctttccaaagagttttccgctataaaaagcagctgtatccgaaagccatgaccctataaatataatccaaactaaaaattcaccatttgctttcacattaacaagatacacaaaactaaataaaattccacaatatataaatccaagcaatgttagtgatgtgtcaataaaagtatatttcaaatttataaccggaaatatcaataatatgaacgttgcagcaacaacaacatacatcatattttcgaaattgttattcaaaagataatatattatcaacaggatatatcccgcacttctcattggttttaaatcattctcttttaatgcattgtaaaattcccataaagccattgctgacaatgcgaatataaagcatttaagataaatccctccaagaaatacaaatactataaatggagcaatcatagcagcacccaaatatctattattagacttcaaaatctaaccactcctctatttaacttttccaaagcgcctatctctattttgataatccgctatagcttttcttaaatctttttctttaaaatcaggccaattaatatcagaataccaaaattctgagtaagcacattgccataataaaaagttactaagcctttgttcccctgatggtctaataattaaatccgggtcaggtatcccttttgtatataaatacttctctactaaagcttcattaatatcttcttcgtttaatttgccattctttatatctgaattaataagttttatagctctgacaatttcatttctaccaccataatttagtgcaaaattcaaatttatttttgtattatttcgagtggtttctaaagcttcttctaatgcattctggcattccttgggtaatttcgaagtatctcctaaaacattcattctaactccattctcatggcattcttttagttccttttttagataagttactaaaagcttcattagtgttcctacttcatctttaggtctagcccaattttcagttgaaaaagcatataaagtcagattttttattccaagccttgttgcttcctttaaaatccttctaatagtctctactcctgctttatgtcccatacttctaggtaaattctgttcttttgcccatcgtccatttccatccattattatagctatatgatttggtatgttattcatatccaagtcaaaatcttgattaaattccttttttgatttaaatatatttaacatctttctccccctagtttattagaaaaacttgacctacccgcatatattctttatatacattattaatactaaacctttttcatatgaagtcaacaataaagtctttactaattatcctcatttaaacaaaatgtaataatatgtattacttttcaacaatttcacaaatattctactcttatagatattgaatctatatttcacttgtcctgagaaaaaatttactttacaacttatcttttattcaaaaacaagttaactcttgtaggagttaactaaattaaccaatctaaataatatatttagatttttactcttcagcttgttcaaagaataaattattcatatactaaattctgaattctaaaatctgcttaaggaaaaaacctgcttttctagcaggctttaaaatttaaaccgataagacttctttttcttttgcagcaattatagaatctatttcctttacaactgcatcagtcttcttttgaacctcatcttcagctttctttacttgatcttctgataaatcctcatcctttttcaatgcttttattttatcattagcagtttttcttattgatcttatagctactttagcttcttctcctgttttcttaacatttttaacaagagtttttctagtttcttctgttaattctggtattactagtctgatgattgaaccatcacttgaaggatttaatcctaaatctgatttcaatatagctttttctatctctttcaatagaggcttttcccacggtgttatcataagtactcttggctctggagctgaaacattagctacttggctaagtgggcacatgcttccataatattcaacatgaattctatcaagcatcgtagggttcgctcttcctgctttcattgttgataaatctgattttaatacagatattgtttttttcattttttcttctgcattttgaataatatccttaatcatgatttttcctcctatttctttttaaagacataaaagaaataatagaccaaagatgcaacgtatatttcgcgtcacacaaggaaataaattctgctcacagcgatgctattagtagagtttactgatgagcagagaagaacccaaatctacgatttggtgtgaatcgcttactcagcgagcgcatgtgagttgagcttccaatggcacaaaataaacaagcatactggtctattattttcttggttgtgttgcaactaatgtacctatattttctccatacatagctcttctaatatttcccggctcatctaacccaaatacaaggataggaatttcattgtccatacacaatgaagttgctgtagagtccattacttgtaatccttgttctaatacttctatatatgatagtgtatcatatttttttgcatctgaatacttatgagggtctttatcataaactccatcaacctttttagctaaaagaattacatccgcttcaatttcagcagctctaagtgctgcagtagtatctgttgaaaaatatggatttcctgtaccagcagcaaatataacaactcttcctttttctaagtgtctcattgctcttcttcttatgaatggttctgcaatttccttcatttctatagcagtttgtactcttgttttaactccaacttgttctaaagaatcttgtagcgctaatgcatttatacaagttgccatcattcccatgtaatctgcagtagttctgtccatgccttctccacttctacctctccaaatgtttccgccaccaactactgttcctacttcaacgcccatatcaattaattctttaatttcaagcgcaattctttttgctacactaaaatcaagcccaaatccattaactcctgctaatgcttctcctgaaagctttaaaattactctcttgtatttacaatctgccatttataattacctcctgaatattttagggatcaataaaacctttttaataagtatatgtactttatttcttaaaaaaagagaacacaaagtgttctctttaggttccaactatttaccgatttgtcttgcaacttcttcagcaaagtctaccttttcaacttcgattccttctcctctttcgtatcttacgaatctagttatcttaactggagaaccaacctctttagatttctcttctaagaatttattgattgtcttatcagaatcttttacccatggttgttctaaaagacaaacttctttaaagtacttttgaattcttcccattaccattttttcaacgatattttctggttttccttcatttaaagcttgaactctatagatttctttttctttttccatagatgttgcatcaacatcatctttacctaagaataatgggtttgctgctgcaatttgcatacaaacttcttttgcaacttcatctaaaacttctgaagccttatcacaagaaacttctactaaaactccaattcttccaccaccatgaatatagctactaactattccattatcaatagcgaatttagtaaatcttcttactgacatgttttcaccaagttttgctattaaagcttttaaactttctgctactgttgcttctccatcaaacttttcttcaagaagttcttctactgttttaactgaagtttcagctaccattttagctaacttatcagcaaaaccaacaaattcttcgtttaatgcaacaaagtctgtttcacagttgaattcaagaactgttcctgttttcttatcatctgaaatatatgtcttaactataccttcagcagcaactctacctgacttcttagctgcatctgcaagtcctttttctcttaagaattcaacagccttttcaatacttccttctgtttcaactagagctttcttacaatccatcattttagctccagtcatttctcttagttctttaactaattgtgcgcttatatttgccataaatttaattcctcctctatatcgaaagtaatccttaacacctaataaaagggcagttggagtgaactcacttacccttttaaagtttatataaactactcagctaattgttcgccttgtcttccttccataatagcatcagccattttagcagttattaatttaacagctctaatagcatcgtcattacctgggattacgtagtcaacttcttctggatcacagttagtatctacaatagcaacaactggtattcctaaaatcttagcttctaagatagcatttttttcttttcttggatcaactataaacattgctccaacgtttgatgcatctaagtttctgataccaccaagattcttttcaagtttttccatttcgcctttaagctttataacttctttcttaggaagaacgtcaaaagttccatcttcttgcattttttcaatttgttctaattttcttattctacctctgatagttgagaagtttgttaacattccacctaaccatctattatttacgaaatgcatgttacttctgatagcttcttcttgtattgcttcttgagcttgtttcttagttccaacgaaaagtatatcttttccttcttcagctacttgcttaacgaagttataagcttcttcagctttcttaactgttttttgaaggtctattatatagatcccgtttctttctgtgaagatatatggagccattttaggattccatcttcttgtttggtgaccgaagtgtacacctgcttctaataattgtttcattgatattactgacattttgttacctccttggtttttacctccactatcttcatcttataaatttcccttaaaataagggcaccaaatctataaattggatagtgtgtgtatttcttaccttaagtagtatatcataaggtatttatggtatcaacaaaaatttttcaatttaacttacataaataaaaatatgcacattatttgtatttaataaaattttattaatcatcttaaagtcttctcaaaatagttaaatcttatacacaaatggaataaactatatattattatttgtattattgtgcttcaaaatttatttttttacttttctcttagaagaaaatctctgaagctgttaagcaagagttttttacgcttctgccttttcaaacacatttaagaaaaatctagctggcgaatacgatttattttttattctttcagatactccactagttaattccccgtccaaaaagttgttcacagattttactgaattataaattccaaaagaataaaaaatagctatagaccattacttgtctatagctatctattatttaatcttttttaactcatctattagcttttcatttaatattctaatataagtacctttcattccaagtgatcttgattcaataactcctgcgctttcaaattttctaagtgcatttactataacgcttctagttataccaactttatccgctatctttgaagccactaaaagtccttcatttccatttaactcatcaaaaatatgttcaactgcttccaattctgagtacgaaagagttcctatagctaactgaactactgctttttttctagtatcttctgttatttcatcctgcatagctctaagcatttccatacctacaatcgttgcactatattctactataactaagtcctcatcagtaaatggattaccgaatctagctaaaattaatgttcctagtctttctctacttcctataataggaactattgttgatagcttatctaccttcttgcacttaccaatctcttgaaatacacatctgccttcattagggagattagataatgtttcattaacttccaacaatgtcttattataatcttctggaaattttttatcctctattacttttttcttcatggcttcacattcaaaatctttaccaaaagtatatccaagtactttcccttttttgcttattatgtacacattacattcaagaacttcacttaataatgtacatatatcttgaaacgctacaggttctgtaccagatttctgcagaatcttatttaacattctagttttagttaataatgatgacatattataatcctccttggcagctgtataacaatattatttagcaaaagaatattattgttagaaaattcttaatttattgaatttttttacaagttgctaccaagactagtttatcatataaaatcttgcttttcaacactctttttattagattcgacaaaataatatcacttatttacttataaagctgttttcttcgtatttatttctactcttcttttgagttatctttttttacttcttctttataattacactcactatttgagcattgtatatagtttccttttgttttcgaatactttgctaccatataggaattacaattaggacatttttcttttactggttcataccaacttacaaatttacattcagggtaacctaaacatccaaagaatttctttccctttttgctcttcttagctacaattggttttccacattcaggacatggaacatctaattcctcaactataggtttagcattcttacactccggatatccaggacatgccaaaaattctccaaaccttcctcttttaataaccatcatacgaccgcatttttcacattttacatcgctgaccttatcttcaattactactttagatatttctttttcagccttttcaatagcaacttttagcggactaaaaaattcctctactatttgagtccaattctcagatccttcttctacatcatcaagctttctctccatatctgccgtaaaatcaacatcaactatttgcctaaaatattcacttacaatattatttactatttcaccaagttcagttggaattagattcttcttttcacgaataacataattccttcctagaagagttgaaattgttggaacataagtactaggtctgcctatacctttttcttctaataatttaacaaaagatgcttcagtataccttggctgtggttgtgtaaaatgttgtgttccatttagtgattccacttttaactcttcattttccttaagctctggtaacattacagaattctcatcttcttcatttgagtattcatatattttcataaaaccatcaaaagagattactgaaccagatgctttaaatttatagtctccattttctatatctattgagtgtgtatttaattcgcatgacgccatttgacttgcaacaaatctattccatattagagaatacaatttatattgctctggagttaaattttctttagcaatttcaggtgtaatctctacataagtaggtcttatcgcttcatgagcatcctgaatatttttcttacctttatatactctaggagcacctggaagatactcttttccataactaccttctataaattcttttgcgctttcttgagcctcttctgaaattcttaccgaatcagttctcatgtatgttatcaatccgaccgtaccataatttttaacttcaacaccttcataaagaacttgcgcaatcgacatggttctttttgtcatgaaatttaattttctatttgcatcctgttgaagagtacttgttgtaaaaggtggaagaggatttctatttttcttacctttttttatactttttactacaaagtttcccttattaagctcttttataattccatttgatgtttcttcatttccaatctcaatcttctttcctttatatgttgatagcctaactggaaatttctttttttcttttttaagtgtacagtctattgaccaatattcctttggtataaattcatttatttccttttctctgtcacaaatcaattttaaagcagctgattgtactcttcctgcactaagtccccattttacatttttccataaaatcggacttatttcataaccaacaagtctatctaatattcttcttgcttgttgggcatcaactaaatccaagtctatttttctagcttgctttatagaggcttttacagctgtctttgtaacctcattaaatacaattctgcatgtttcatcctctgaaatttttaatatattggctaaatgccacgaaatcgcttcaccttctctatcggggtcggttgcgagataaaccttttctgctttttttgcagcctttcttagtttatctattaattctccttttcctctaatagttatatacttaggagtatagttattttctatatcaacacctaatgtactcttaggtaaatctcttacgtgtcccattgatgcttctacaatataattcttacccaaatatttgccgattgtttttgctttagccggcgactcaacaattacaagtttttgacccatagtataactccataaaatttatgaagtattcaccccctacacatttttaaattgttttcacatagtaatttcccggtagacaaataatttcactttttatttgcatttcaaataataatgcgtataaagctcctctatcaacagacgtatttttaaaaatatcatctatgtgaattggtgaatctgtaattaactctagtatttcacttttctctggtgtaaaattcattggttgaatttcaatatgttctaaactaagtaaaactcttaaatcctctatatcagtacatatactagcaccatctctaatcagtttgttagagccacttgctccagcatataatatagagcctggaacagcaataacttttttctcctgctgctgcgcaagtctagctgttattaaagatccgcttttttctgaagcttctataactattacgccatcactaagaccactaattattctattccttttaggaaagttttctcttaatggcgctgtaccaagtaaaaattctgaaattactacgcctttttctgctattttagaaaacaacattttattttcagatggataagttctatctattccacatcctaatacgcatatgttatatccatcattctctaaagctgttttatgtgcaattgaatcaattcctcttgcacctccgcttataagcgttatattattagtaataagctcctttgtcaagagttttgttacagttagtccataatttgagcattttcttgcccctactacacctatagatttattatttataatgtctatatttccaatataaaaaaggaaataagggggatttaaaatcccgctcaatttctctttatataaaggattagagtatgttatatatcctatattttttttatataatgtttcttctaattttaaaacttcatagtataaatcatctttttgaaaattttttaattttttagatattgtttcattttcttttaatatctcctcaaaattattatatacattttctgctgttttatatttatttattaattttattttttgaaaacttgttatatcaataagtattaaccacaattcataattcatttatacatgttcccttctaaacctatataatttctccattaatatttttcctataactaaaagcttctagaatatgaaactctaaaatatccttttgattgtctatatctgctatagttcttgccaattttattacttttccataccctcttaatgatacacttgatgtgttataatatttttttagaagctctgaacatttcttactaaccctgcaaatttcaaagatatcctttccttttatatctgaattatatttataaactgtattcttaaatcttagtttttgtatttctctagctctaagtacattttctttcatagctttcgaatcgtatgaatctttcttgttttctatttcatcataattgagtctaggtacgtaatttaatatatcaatcctatctagcaaagcgcttgaaaatttcctagaatatttagtaattttagtattcaaataatatttgctatcattaaaatctttatcctcattgttttctactggattaaacgctccaattagtaaaaaatcagcaggcatttgataacttccactaagcctattaatattcacatttttttcttcaagaggttctcttagagattcaagaacatccttcttaaactccaaaatttcatctaaaaatagcacaccattatgtgcaagagttatttcccctggccttatttcttttcctccaccaattaatgctattcttgtagttgtatgatgtggcgctctaaaaggtctgttaagacgagaaatccttgtcataagaccacatgcactatatattttggcaatctctattaattcctcttgagataaagatggtaaaattgaaattaatgctttagcaagcattgttttaccacatcctggctctccataaagaattatattgtgttttccagctgctgcaatctctaatgctcttttagaagaatactgtcctataatatctccgtaatctggcgaatctaatatttcttcatcttttccatcttcatctatctcataaggaagcatatcttcatatgtaatgtgcgagactacttcttttaaactttttaatgggtaatattcaacattcttaaaataataactttcttctaagttttcataaggaaagataaattttctaatttccttccttgctccttcaattattataggtatagtaccttttacccctttaagctcaccaaatagagataattctccgaatataatataatcctctaaattctttctgcaaatctgatttgattccattagtataccaatcgcgattggtaaatctaaaagagatccaatttttctcacatccgccggagccagattaatagtaattctacctaatggaaattcaaatccacagtttaatattgcggctctaactctttcttttgcttcttttactgaagtgtctggaaggcccacaatattaaataccggtaagcctttagatatatctacctctacttttattaaaaaaccttctaatccattgtgcgttgcactaattatttttactgccatataaatcacctactaaaaattatagacatacattcaaatattaattccataaaaatacatttgttatatttattttttaattgttaataattcaaagatataatagcaatacagttaataatttttaatatgtttcagtaaataaaattggaagtgatatagtgaaaaaaataaataaagatataggtagttttagcgaagatttagccaagaaatatttagaaaagaatgattatagtattttagattgtaatttcaaaaactttttaggcgaaattgatattatatgcaaaaagaatactttactaattattgtggaagttaagagtagatataataataattatggattgccaagagaatctgttaatttttcaaaacaaagatccataataaaagtggctaattcttatattaattataaaagattacctaatattaatgttagatttgatgtcattgaagtttatctaaatttagagagtacaaattttaaaataaaccacataaaagatgcctttagactcaactaattacttaactcaccttagtttttctagccctttttgtatccccttaatgtatgattattgctacagcatataaaataaaaaagtccataagaatattatttattttaatattcttatggacttcaaatcaacttctttatcttaaacacataaataccattcatataaatttcatttgaccaaaacttaattacaataattttgttaaaaagctatttctatgaatgtcgctttttccgtatttttttagaccttctatatgttttgatgtgccatatccgacattattttcaaagtcataatgtggatatttcttagcatactctttcataagtctatctctatacacttttgccacaattgacgccgcagcaatactagcactttttgtatcaccctttatgacagatttattctctataccaatgttcttaattaaatagccatcagataatactaaatcaggttttatactaagtgaattacaactttctaaaaacactttattatttgcaaaagctattcctttttcatcaatttctttattagaagaaactgctatttgataacttaatgccttttcttttataatttcagaaagttcttcccttttatgttcttttactttttttgaatcatttatatataagattaaatctttttctaaaacatttaaatcaagaataacactacaagctacgattggacctgcaagaggtcctctaccaacttcatctacaccagctatatatcgataacttccaaatgatttatcaaactcatacattgttttgactcttttaacttcatttaaatatgattctaaatctttctcaatcttttccttaagtgataatacatttttccttttatcttcttctagccagtttataagttttgtatgttcatcatttctatataaatcaactatagataacttatgtatttcttccttaatttccgcaaatgatagtgatcttatatcttcattaaactgtatcattttcttctgctgggcgctccaatgtgatattgcccatttttcctcccctgaattcgtcaagtagtataacagctattctattatagtcaatttgtcctccagaaattaaagtacctctttttttgcctatagcatctaatgtatctaatggattttcaaaaacttctttaagtttatatctttcttttaatttctcttcataattactttgtaatttttcaacaagtttcaaagctaattcttctatatccattatttcatcttttatagcaccagtaaaagctaaattcaaagctgtttcatcatcttcaaatctaggccataacactcctggggtatctagcatttcaatcccaattcctgttttaatccattgtttgctcttagtaactcctggcctatcacctgttttagctatattatttctcgccattttattgataaatgtagattttcctacgttaggtattccaacaaccattactctcattgttatattaaccataccttttgcctttaatctatcatgcttttccttaagtaatgctaataatgtaggctttatattcttaagtccatcaccttttaaacaattaacctctaatactttaacatcatctttggttaaataatttatccactcttttgtaactttgccatcggttaaatcactcttatttaaaagtataattcttggttttccctctaacaatttttcaatatcaggatttgcagaactccttggaattctagcatctcttatttcaattacagcatctactaatttcaagttttctttaatttctctttgggtttttttcatatgtcccggaaaccaattaattgccatatgaattcctccttaaatttatttttcagttcacaatgcacatttcataccatttaaggcaccctgtagcaaatcataataaaatcacttagacttttattattagaaaactccttgaattttccatccttaattatacactgtacattaatcacatattaatattaattttctcatataataaaaaaaaggactgaaacagtcccctttttaaatactatctagttaataattctttaactttagcagacttaccaactctatctcttaagtagtaaagtttagctcttctaactttaccttttctagcgatttcaattttgtcgatgattggtgcattcattgggaatgttctttcaactccagttccgtaagcaactcttcttacagtgaaagtttctcttaaaccaccattttgttttttgataacagtaccttcgaacatttgaactctttctttgttaccttcttgaatcttaacgtatacctttatagtatccccgatagcaaatttaggtaagtcagttctgatttgttcagcttctatagctcttattatttcgttcattgtgcattccctccttaacgataatttgacgttcttaacacatatgtatgacagcggaacgcccgtactagcacaaatttaatattatcacataatgttttatatttcaacaaaaattatttattatttttattttttaatattttaatatcttctttggttaatgtaattttcttatataaatctggtctaatcttctttgttacctcaagagacttaagtcttctccattttcttatattttcatgatgcccagatagcagaatttcaggcactttatctccttcaaactcttctggtctagtatattgcggatattctaaaagtccattataaaacgactcttccataaagctctcttcttttcccaaaacacctggaattaatcttaatatacaatcaatgaccggaattgcagccatctctccaccagttagcacaaaatctccaagtgaaatttccatatctatatgcttataaactctttcatctattccttcataatgtccacataaaaatataagcccttcttccttagaaagctctttagcaatctcttggttaaaggtttttcctctcggccctaagaaaacaaccttccctttattacttaactttgcatcccttatagtatcaactatgggctgaggcgccataaccattccagcaccaccaccataaggataatcatcaacttttttatgtttgtttaatgtataatctcttatgtttagcgtttctaaatccactatgttattttctcttgctcttcctattatactatgatcgaaaatagaaaacatttctggaaataacgttaatatgctaatcttcatcttgccattcacctactggcttaataatgatttttttcaattttatatctatatctagaactatatctctaagaactggtattaatagttccttaggttccttaatccaatatacatcattgttaggagtgcttattacatcgaaaattcttccaatttctttttcattagtatcatatatagtacattcttttaaatcagaaacataatatgtgtcaggtggaagttctggctcattttcgcgtggtatttcaatatatttttgtttataagtctcagcatcattcatagagtctataccttcaatttttagtatcactctatctttttgaaatttaactcctaatattttcttttcctctccacctactaaaacagtttctagacgtttaaatttattcacatcttctgttagaggatagactttaacttcgcctttaattccatgtgtatttataatctgaccaattttaaataaatttcccactcttttcacctcattttaagcataagaagaataatggcataaaataacttagagacgcgtatgacgaaaaatagaccagcatactgacttgttgttatttttaatagtatcttatactgaaatccattatttttttgattatgccctatataaattattatatacttttttctttgaactcattattaaagatattagattgcctatatgatcttagtttcacttaacaagttccgaattgttaatcgcactcttctcatatacgtgtgctttttcatatacgaattaatcttaattgtgctgacgcgcatttttatagacgaaatgttctcaattgcgcttacgcgcttttttctaatgtgtatatttaaaaagagttaggtttccctaactctcaatttttagatgatttctactataactcgtttattctgtttaactgctgcagcttttataactgttcttatagctttcgcaattcttccttgcttacctataatcttacccatatcttctggtgcaacttttaattcaagtattatggattgttctccatctacctcattaacagtaactgcatctgggttgtcaacaagggatttagccataaattcaactaattccttcataaacgcctacaattagtatgtactaactgcagaattcacctccaaaaattacttagtaagacctgcattattgaaaagtctcttaactacttctgttggttgtgctccattagataaccattcattagctttttcttcgttgattttaacttcaactggttcagttaatggattatagtatccaatttcatcgatgaacttaccatctcttggtgctcttgaatctgcaacaattattctatagaaaggagctttcttagcacccattcttcttaatctgatttttactgccattttaatttcacctcctttaaaggataataaatatatattttaactctaatgcttagaaaggtaacttgccaaataggccgcctttctttgcctgcttctggaatgacttcatttgcttcatgttctttttcatcatttcatagcccttcatgagtttgttaacttcttgtatattagtacctgatcctttagctattctgctttttcttgatggagattttagtataagacttggatttcttctttcttttaatgtcattgattgaataatcgccttagtcttatcaagagcctcagtccccttatcaaagtcaactccttgaagttcctttgaatttaagccaggtatcatttccataatcttatttaaaggtccaagttttttcatctgttccattgccattagataatcctcaaagttaaattcttgatttaacattctcttacctaaatcagctgcttccttttcatcaatggcttcctgagctttttcaataagcgataatacatcacccattcctaaaattcttgatgccattctatcaggatggaacacttcaaaatcattcattttttcgccaacaccggcatatttgattggcttatcaattatagtcttaattgacagtgcagctccacctctagtatcaccatctagttttgttaaaataactccacttaaatctaaatcattattaaagttttctgcaacattgacagcatcttgacctgtcatagcatcaacaactaataatatttctgacgggtttacattatcttttatattttttagttcctgcattaattcttcatcaatgtgaagtctacctgcagtatctatgataactacattatttccattatcttttgcatgagtgattgcattctttgcaatttcaacagggcttactttatctcccatcgaaaatactggaatttcgatttgttttcctacaacttctaattgctttatagctgctggtctataaatatcgcaagctaccaataatggctttttattattttttctaaggtttagcgcaagtttaccacacatagtagttttacctgctccttgtaatccaactaacattataactgtaagtcctgaactactataattaagtttactttcagttccacccataagattagtaagttcttcattaactatctttattacatgttgtcctggtgttagactttcaagaacttcacttccaacacatttagaactaacagaagaaataaattgtttaacaactttatagttaacatctgcttctagtaaggcaagctttacttctctcatggcttcttttatatctttttcagtcaactttcctttaccttttaattttctaaaagtctcctgtaatttttcacctaatccttcgaaagccatgtttactcctccttataaattttctagcttttctttatattttataatatcctcatcatctatggaatatttattttttaagtgttctaaaaaattcataatttccttttttctatttatactcttttgaagtaagttaagtttactttcataggagagaagttgtttataacatcttttgattaaatcatgaatagcctgacgactcgtttgattaagctcagctatttcagctaacgataaatcatcattataataccactgcataatttcactttgcttttctgttaataacggaccataaaaatccataagtaacgaaatctcaactctatcttccatttaatcaccttacccacaaaagagattttaacaggattatttcaaagtgtcaagtatttttacttaacactttgatttttttacatcaaggctttatatctcaagtttcttgatgcaattaatgacttttaaattatttatattttatatactcataaccaaaaaccttgaactcctgatgtttccaataaatatttacatattttcatatgtaaatttaaaaatatgaatctttaaaactatttttatataaatctatgtacctttaaaaatgtgtttatagaaatatattttcatataaatattcaaacatagtttaatttttatatatttttctagaaatatttttaaggcacatgaaagaaaataatagaccaaacatattggcctattatttcttatctaaccctatattaatgcttcagcaaatccttctgcatcaaatgtttgaagatcatcaatgccttctccaactcctatgtatctaacaggaatatttaagctttgctttatagataaaacaacaccaccttttgctgttccatctaatttagttaatattatcccatctataggacaagcctccatgaactgctttgcttgaataacagcattttgacctgttgttgcatctaaaactagtaacgtttcttttctatagccttgcaattccctatcaattattctgtttatcttttcaagctcattcattaagttcttcttattatgaagccttccagccgtatcacatattaatagatcaacatttctagcctttgacgcttctattgcatcgaaaacaaccgcagccggatccgatccttcctgatgtttaactatatcaacttcggctctagagctccatacttcaagctgatcaatagcagcagctctaaatgtatcagctgcagccagtaatactttttttccttcttgtttattctttgctgcaagttttcctatagatgtagttttaccaacaccatttaccccaattataagcattactttcttttctttttcgtcatcttcatatgtaccttcaagtaatatatctctaattacttcctttaatgccggttttacttcttgaggatcgtttattttttcttttctgattttcccccttaatctttctataatatctactgttgtgtccataccgatatcagacatgattaatatttcttctaattcctcatataaatcctcatctatagttactgccaaatttaaggcctcatttatcttatctgttagtccatctcttgtctttgctaatccctcttttagtttattaaataaatttccaaacaaattcatttcctcctaattaaaattttctgctcaagcgaaacttgatttaagataagtcatctcatcttaaatcttagtctaactaatccagaagcttgcagccgttacctctcactaaaagtaggaggtttacggatgctagctatcggaaaagtctactgaaactacctttgatacacctttttcttccattgttactccatatataatatcactcacctccatagttccctttctatgagttataattataaattgagtatttttagaaaacatttttaggaactctgcatacctatatacatttgcatcatctaaagccgcttctatttcatccaatatacagaaaggcgttggtttcatctttaaaattgcaaaaagtaaagctattgcagatagaaccttctctccaccagacatcagattaatattttgaagtttttttcctggcggctctacatttatgtcaatattggctgtaagctcatcaccttcacctaaaataagctcagcgcttccacctttaaacaaatctttaaaagttttatcaaaattataattcaatattttgaagttttctttaaataaacttttcatttcattagtcatttcttcaataacggcatttaattctcttttggcattttctaaatcctctgcctgagtagacataaactcatacttttctttaatttcttcgtactcttctattgctgctaaatttactactccaagttttgttatctttcctttagtaacaaaaatttcttgtttcaaagcttcctcatcaactactggctcacatttatctaatgcctctgcataagttaattctaactcttcattaagtttcttataaacatgctccctatcattttctttcttagctttaattacttctcgtttattaacttccatttcttttaagctgacttcatccaaaataccgcttattacattatctttttctttaaattcttgctttaacttttcttttaatatctcatcatctttgaagtttacttctaaattgctgatattaatattattttcttcaatattcttattcttagcctttatatctaaatttaaactttcaatattttttttattttcctcattttcattatttaaaagttcatttttaatctctaaatccttaatttctttttctattcttaaaaattcattctttttattttctattgcctcatccaacttagccttactgattttcatttctgtaagcttagtatcgctatcgttaacttcttgaactttgattttcattaactgttccagttctatacttttgctcttgttagctgtattttcactttcaatcacctgaacctcagattctttagctctaatcttttctaatatagcttctctttcacctgctattctttttatttcttctttagcagtttctagatttctctttaacttatccgtatcagactgtaaccctttaatctcactttccttttttgtaagttcaatatttttctcatgaacttcatcccttttattcagcatatcctcatctaggtcttgtatttctttcttgatatcttgaactagtattttcaattcctcatatttctcttttttattgcttatatctaatactaattcttcaatttctctttttctacctagaacatttgaatttttcccctttatgctaccacctgttaacgctccccctggatttatgatttctccatccaaagtaacgattctataattatattttccgattcttgcgatattaagagcgcagtccatatcactacagattattgttcttcctagagaataatccattatatttttatactctttatcataagatattatgtcacttgcaatcccaatatatccattagcttcagttatacttctatctaattctaacttctttccttttataatatttaaaggtaaaaatgtcgctcttcctagactattttttttcaaatatcctataagaacttttgctatttcttcattttttgttataacatttgaaatcgcagcacctaaagctatttctatagcaacttcatactttttacctacagtgaaaatttcacctaagactttagtatcatttgcagccgtaattctttccctatgaattgattccattaaagattttactgacctgttatatccctcataatgcttttccaagttttctaacattgatctatttgcatcaagttttgttaaagtcccacttaattctctaagctcattttcttttttagttaaatttgctgatagagaacctatttttttcttatgctctactatttgcatatttagcaattttatattgtctttattcttttcactttcattggtcaggtctttataagtcgctaaattaataacaatattattttctagaaaagatatagacgaatttagggtttcttttttctcttctcttagcgagagatctttatttagcatagtaatctcattcttcatatctgagttacttcttaaaagttcaaattcaccttctcttagagattttatttcttcatctatacttttaagttccttagaactttttatattgttttcttctaaatttactatatcttcttctcttaatctttgttcctttagtctttcactcaattcgctttctaataatttcttgttttcattaagctgatttaccttaattaaaatatcatccagctcataattattcctattgatcttttcttcaaaactcttaattctttctttataaagttctatacttttttcatcttcactaacagtttcttttaagctataatatttctctttttcttctaaattcttcttttctagcttttctattttcatctctagttctttaagttgtgacttataactagatacttctttacgcttatcttcaatttctttaatttttaaatttaaatcttcattgaacccttttaattcttcttccattttgtctatggtatgtactataagtgatacttcttttttcttcaaattattagataagtcagtaaattctaatgctttctctctttcaatccttaggggttctattctctcttcgtaagttgacagaatatcatttattctaactaaattttcatctgtattgcttaactttttctctgcttcttcttttctatttttaaactttacaatacctgcagcttcctctaagagatttcttctatcttctggcttaccacttaatatagcttcaatcttaccttgtccaattagtgagtaaccttccttaccaattcctgtatccataaaaagatttattacgtcttttagcctgcactttgaattatttattaaatattccgattctcctgatctaaatattcttctcgatacaactacctcgttatattctgtcgcgagcttttcatcactattatcaagggttagtgaaacctgagcaaggcccactggctttctaaactgcgttcctgcaaatattacatcttccatttttccgcctcttagaaccttaacactctgttctcccagcacccatcttaccgcatccgaaatattactctttccacttccgttaggtcctacaacagctgtaacgccttgtttaaattttaattctgttttatcagcaaaagatttaaatcctcgtatttctagagattttaaaaacatgtgtcctctccttaaaaagaaaatatactaggtaataatgttacaataaagattactacaataaaaatagtcattgcaattatcattttttctctagtcttttttttcatatcaaacaactccttattataatttagtttatagtaaagcttattaaatatcaataattcacacaaaagaaaatgttaaggcatatgaaagaagaaaacaggattgacagatagacttgtcattttttgattatgcctaagttaaaattcataaacataattaacattttaaaagcgagagtctcctctcgctagtatgctatgtctaactttctatttttcaaacaaagttttatatgacctctttcaatatcatcatcttgtttcacatcaacaatcttaccattatctttaagcctgttaaaatataattttttattagcataaagcttacttacatcttttgagttaatataaattactccatttttttcatccgtcatattttctaaaataatatctgacaataaactgccctcaactaattctctaaatgatggatgaaaaggacctgccactatatctttcccttcatttatactttctgtcggctgaagaccaattcttattacgttgatgttatgctttttatacatatcatacataaccttacttacattaacagcctcttcaagagaatatggaatgtactcgttattaatatacattctttccattggagtatcttttataactaacgacggatatattctacaaatatctggattcatcttaattgattctttagtcgtttctatatctctttcaaaagtatctccaggtagtccaggcattatttgatgtcctaatataaatttatattcttttattaatttagatgcatctataacatcatgaacgctatgtcctctgccagctttttttaacacttcttcatttagtgattgaactccaagttctattatgtcaactccatactctttaagatatgtaagtatgtaatcattgatgtaatctggtcttgtagaaagtcttattttatctataagacctttttccttaaactccttagccacttttagaagttccctttgtttttcttccctaattcctgtaaatgtaccaccaaaaaatgaaatttcaatagttgcatttttattctttatagtttctagataatcatttattgttgtaattacggaacttgccgtaacctcttcatcatcaacacctgttattctatcctgattacagaatacgcaattatgcggacatccttcatgaggtacaaagatcggtattatataataatttttactcatgcttaccttccaatatatctaatgcctgtttagctgcattttgttctgcttcttttttactatagcctgaaccttcacccattaactttttatctattactacatttgtaaaaaattttcttctgtgaggtggtccttcaaatttcgtaagctcgtattgaattactacttctccatctttttgaagaagctcttgaagctttgtcttgaaatctaatacaatttcattatttattgctttatttattatctcttcaaaatgaagcaatataaaatctcttacaaagccaatgcctttgtctaaataaacagcagcaatgattgcctcaacagcatctgcctgtattgaaattctttctcttccacctgtaatttcttcacctttactcattctaatataagatcctaagtttatcttttttgcaatttcataaagagaattttcacaaactatcaagcttcttatttttgtcagctcaccttctgttttatgtttgtaattattaaaaaggtattccgtaatacaaagttgcaatactgagtctcctagaaattcaagcctttcattatactccgcatccttgaattgatttccaaaagagctatgagtaagagccgtttttagtaatgtgtggttattaaaaaaaacccctaaattttcttctatttctttaagtgtatatctattcatgtattccactccttgaagtttattcttcaacttgctaacctattgttatatacttctcataacaaattcaagaataaactattaatttgatattttagttactataatgatttttcttcctaaattccaactaaaaacatcgttatcatagacagtaacatttgtacgccaatatattactaaagtacatttctcactaaaatctattttaaaatgattttaaatttagttctcactttgtaaaatataaaatcccgcaagatgcgggattattttattcttcgtgatgagcttttacgtaattgacaacatctccaactgttttgaagttttcaacgtcttcgtcaggtatttccatatctagttcatcttctagagccattataagctcaactatatctaatgagtccgcatttaaatcttcaataaatgatgcttccataacaacgctttctacatcgatacttaatttatcagcaataattgcttggatcttttcaaacatttgtttcacctcccaagttctacatttagataatattatatattgtttaaatcgtcaatattagtttcaatatattttaactaattttccgaagaaaattcatttcttatatcttttaatacattattatcatagaaaattttagtttgtttaatggaattcttaaacgctcttgcatcagaactgccatgagcttttatacaaatcccatcaacccccaagaacggagctccaccatattccttataatcaaactttttcattatattttttagcacaggttttagcagaaccacccctattttagatataatcgacgatttaagcacctcatctttaattatacctaatatactcgaagccgatccttcatacatcttcaaagctgtattccccacaaaaccatcacttactaaaatattagtgtcaccagtaggtatttctcttggctctatattccctttgaagtttatggaactttcttccttcaaaagcttaaaagcagcttttgtaagttcatttcctttttcttcttcttctccaatatttataagtcctatagtcggatttttaacgttgaaaaccttttgataatatatttttcccatctttgcaaattgcaccaaaaatgaaggtttgcaatctacattagcaccaacatctactatcataaactttccacgtctcccgggcattataggtgcaagagcaggcctttctattcctttaattctgcctattatcaacgtacacccagctaaaaatgcacctgtactgcctcctgatacaacagcatcacaaataccttccttaactaggtttaaagccttaactatacttgaatttttcttctttcgcaaagccataacaggatgctcattaggtgaaattacttcctttgcatctaccacaataactttttccttgggataagtatatttagctaattctatatttagaacctcttctggacctgtaatatataattggatatcgtcatatgccttaagagcttgaatagcaccgtctattactgctacaggtgcattatctccccccatgccatctatagctattttcatctgaatacctcccttcttccactttaattataaataaattaatttaattaataaatagaatattttcttttttagataaagattatttaacttatacttatgtgataataaacccaaagtagaaacatcgttatttctcagaaccatgaaaatttcgctaagaagttttaagtataaatctaatagtacaacatatatctatatatatttctttatataagaaaagaaagtcataaagactttcttttatttttcagaagctacaacttccttacctttataataaccacaatttttacatactctatgagcaagtttcatttcgtggcattgtggacattcaactatgccaggtaaactagctttaaaagtttgagctcttcttgcttttactttagcttttcctgattttcttgctggacaacccattcattacacctccttattatcaaacaaacctttcaaggcctcaaaacgtatatctacatcttctttttgacatgaacatgaattgtgatttaagttacatccacattcttgacaaagccctttacagtcgttcttgcaaactcttttaataggtagtgttgaaattatgctactttcgacaatttctgtgatgtctaaaacatcatccattacaacaatagcttcatcatcaccactatctctattagttgtaaacctttcttctatatcaatatctattggatagataaaggtatctaaacatcttgaacatatcatttctaaatcagttttgattttagcattcaatattaatatatcaccatctgataagatattcccaacaacctcaaaaggttttattggtttaattatatctccttcaaaatcaaattgcggtgcatcaaatatatagtcaattttcttgcttctatctttacctgaaataatatctgaaatttgtactttcataaaatcacaggataatcatataataaaactaatgtaaactatataatatctcctctttcactccttagcacatatatttataaaacaaacacaactaattatataaattgcgtgctaaaaagtcaagaaatttattataaattcctatttctccatatgaaagaaaataacaaactcatgatacaaatgtttttgtatctatactaactgctcccctttacgtatatattttcttctataaaggaagtacagccaaatatattgtataaagctattgaaaaaacatgctgataaattataaataaaaaccaatcagcatgttaactcaccattttttcaattatgccttacttaactaattctaaagtttctttagcaatcattaattcttcgtttgtaggtattacaactacttttacctttgaagtttctttagaaatttccataccatctccgatattatgactttcgttcttttctaaatctacttctattcctaagaattccatattagttaaagctcttgatcttatttctggagcgtgttctcctattcctgctgtaaatacaattgcatctacaccacccattacggcagcataagcacctatttgcttcttaacttgatatccgaatatatccattgtaagtaatgctctaggatcattatcattttccacagcacttctaatatctctaaaatctgttcctattcctgatatacctagaacccctgatttcttatttaagatatcatttacttcatctatagaatatcctttttcttttactaaataagtaactattgctggatctatgcttccagatcttgatcccattataataccatctaatggagtgaatcccattgtagtatctacagattttccaccatcaacagctgtaatacttacaccattacctatatgacaagttactatctttaaatcgcttatgtctttattcatcaattttgccatttcacctgctacatacttatgagatgtaccatggaatccatatcttcttacgtgatcttctgtatataattcatatggaagagcatacataaatgctttttctggcatagtttgatggaatgctgtatcaaatactgctaccattggagtttttggcataagagccttacatgcatttattccaattatatttggaggattatgaagtggtgctaattttgtaaattcatcaagtgccttaattacttcttcattaattactactgaagttgcgtatttttcaccaccatgaacaactctatgtccaacagctgatatctcatccattgaacttattacaccatggttttcatcaactaagcattttaaaacaagttctattgcatcttgatggtcttttaatggcgtttcaactacatatttatcttttccttcaactttttgagtcaatattgacccagtaattcctattctttcaacaagtccttgagctaaagactcttcattactcatatcaataagttgatattttagtgaagaactaccacaatttataactaatactttcataactctactctccttttaacattcaaaccttttgtatttttgttttaacaatctataagctaacttactttaaattatctgtaaaaataatacttactatttgtttgtttgagcttgaactgctgtaagcgcaacaacacttacaatatcatctgagctacaacctcttgataagtcattgattggttttgcaaaaccttgacagataggtccaatagcttcagcatttgcaaatctttgaactaatttataacctatatttccagcttgtaaatctgggaatactaaaacattagcttttccagcaacagtactttctggtgccttttgagccgctacttttccaactatagctgcatctaattgtagctcaccatctatatctaagtcaggtctcatttcttttgctttttgagtagcatttctaaccttatcaactaattcattatcagcacttcccatagtagagaatgataacattgccaccttaggttccatgttacataaattcttagctgtttctgcagtagctattgcaattgctgctaattgatcctcgttagggttagggttaactgcacagtctgagaatattaatgttccttcttcaccataagatgatcctggaacttgcattataaagaagcttgaaacaacagatacccctggtgctgtctttataatttgtaatcctggtcttaataaatctccagttgtgtgaattgctcctgataccattccatctgcatcatctaatttaaccatcatcgtaccaaaatatagaggatctctgactattttatctgccttttccattgtaacgccttttgtctttctaagttcatagaaggcttcaatatacttttctaatttatctgattcatttggatcgataatctcaattcctgataaatttacatctaattcctttgccttattatttatttcttctttgttacctattaaaattgggtaagctaatcctaatttttgtattttttctgcagctgctatatttctttcctcgtttccctctggaagaacaattttttgtttatttgattgtgctgcagtccatatttttttcataaggtccataatctatttatctcctctctatatcctatctctaatactaatatactcctttatcagtgcttttttcaacacaaattctctataaaatagaagtctttagatttgaaataatctaaattgtcagacaatactcctgtaaaataacaatataggaaaagtataatttttaacaattaaattttatttaaaattattttataatttattattaaacgctatcaaatgttttaaattattgacctaatatatgaaaaatacatgtctatttcatattattttcattaactttttcttaaaaatctatagtatattcattcaactagctgtatataatctattttcttgccaatattaagcaataattaaaaattcaccattcttttaatgttctgaatattttttaaactactttttaatagagtaatattaaaaaagtatattttttaacaataattttataatatcttattgatattttacaaaaaaaatgcacaacatattaaactcttaataactaatattataaaattccataatatgctatactagctttataaaggagatgattttaatacttacaggaataattacagaatataatccatttcataaaggtcatgaatatcaccttagtaaagcaaaatctgacacaaacgcagatggtatagtttgtgtaatgagtggtaattttatgcaaagaggaattccggcaattatagataaatggaaaagagctgaaatggctattaaaaatggtgttgatctagttctagagctacctctagtttattccatttcttctgctgaacattttgctttcggaagcgtatctcttcttaactcgttaggcgtaatagatcacttatactttggaagcgaagaaggaaatgtatctatattagaagacatagccaaagttttagtttccgagcctttaaattataaaaaacttttaaaatataatttggactctggcttaccttttcatttgagccgagcaaatgcacttaaagattatttaaactcaaataaattattagatacaatatcaaattctaataatatcttaggtattgaatatataaaatctctaattcgtttaaatagcgcaatagttcctaaaaccatcaaaagagaaggttcattatataacgatgtcaacataagcgcttcatttgcttctgctacatcaataagaaaacatctaaaagagaaatctttaaatgatttagctgatattatgccaacggcgagctatgacattctgcttagtttatcttcttctaactatccttttatttttgaggaagatacctttaaatatataaaatataaattactcactaacgaaagatctcttttaaatttgccagatgtatcagagggcatagataataaaatattaaaagaaattgtaagatccaattcacttaacgaattaatattgaattcaaaaagcaaaagatatacatacacgaggataagtagaattcttttgcaaagctttttgaaccttgaaaattttgatttatcaagcttatctaagagccctgcgccttacgcaagagttcttgcttttaattctacagggcaaagaattctaaagagtataaaaactaattctagtataaatctaataacaaaggtgccaagaaacaatcaatgtgatcatctaaaaatagatatcttaggaacaaaagcatattcactgctaaatccaaaaataagtcctatggatgattatttaaaagggccttttataatatagtaatattttacataaccatgagaatataaatattattgattggagtgatttcatgatatatattattatcttatggtttcttattattagcttaatctttattttaatcaaacaacttaatatcaaaaaaaatactatcatttgtatatttatatccgtcttaatagttctttttgttttaaacataaaccaatgcatagtcgcagctattgatggttgtaaattatggtataactcaatattgccaacaacctttccttttgtagttatatgtaatttattaatatactacgatggaataaatctttattctaaatttcttgggccattaatctgcaaaccattaggcctttctagaaattgttcctttccaatcgtagcaagtatactatgtggctatccattaggtgctaaatattgtgtagatttatacaagatggaatatatagataggaatgaatacgaaagacttttaaacatagcgtctaacgttggtcccctgtttttaatcggatctgttgctggaactttattagggaatgtatccttaggttatatcttgcttctaggaagcaatttatcaataatcataatgggatttttgacaaaaaaaaagagaaacttaaatactctaagttctctcccttgtcctaaaaatgaaagtatgaatttcggtaatgctgtaaaaaatgcagttcaaaacggaataaacaccacattatctataggtggtttcataataattttttcagttgttatatctcttgttaaaaacaatccttatattcatattgcatttaggcagctagataatgttttaaaactgccttcccaaactttatacagtatatttttaggaagcattgaaatgactaatgggtgcagtataatctctcccctagaaatttctatccccttgaagcttggtataataagctttttaacttcattttctggtcttgcggtaatcgcacaagtaagttctttcgtaagcgatactaagataaattatagcagatatatttttttaaaagtaatccaaggaatcgttagttttattataacttacgggttatgcaaagtgtttcctacaagtatttatacatcaaacttacaaatgagccattcttcaagtttatttgtatatatatatcctgcattaactatactgttattaacacttttattaagtatatttaatagaaccttgaaattattttttcataccgcgtaattctttaatattctcttttataacatcgcatgtaccagttaaatttgtatctatctctttagctactacttcaaaactttcttgaaggctttttattaattttattttgtgttcttctaattcctgatctaattgggttaatatttcatcagaataatccctagaccctaatcttatagccttggcctctctctgtgctgaggctataatttcttgtgctctccccttggcttccctcactatatcgtgattctcgacattctgtctcatcatagtcattgtttcttttctaacagaatcatactcttttttagcttcattaaggattctttctctctcgttcataacccattcagcttttttaaattgatcaggcatatagttaattatttgatctattacatcaacaacttctcttttatctatcataactttaccgctcattggcactttaggtgaattttccaccaagtcttgtaaatattctaataactctattatatttacctccattttttccataaaaacactccttagatatttattctataaatgatcaaaataccaggaacaaatcttaatctagtatttttaattgtttttagtattattaatatcattaattttaagtcaatgcggctgcttaaacacagcacattctaattatgaaaatacttttccttaaaaaatcaccatttatagatttattctggacattatatctgaaataatttcattgggaacaagtccactaatatctcctccaaaccttgccacctgcttaacagttgaggaactaatatgtatatttttagccgatgacatcatacatacagtttcggtatcatcatctaattctttattaataaacgccatttgaaattcatactcaaaatcagaagctgttcttaatccctttaatattatattagtcttacattcttttagaaaattaactaaaagcccatcaaagcttcgtatttcaacattctcaatatctcttgtcactctttttataagttcaactctttcgctgctttcaaaaagatatttcttatcaacattaactaatactgcaactattactttatcaaagacctttgctcctctttttataatatcgagatgtccatttgttataggatcaaagctcccagggtacactgcaactctcattgtttacttctcctcatgcttgtaataacatactgttgtatttccatacttcttactttttgttaatcttatatctttatacccttcataaatctcttcaatggtatctattttagtaactattattccatcattctttaaaatttcattatccttaacaattttcatagcttctggaatcatttctttgcaataaggtggatcaataaatattatgtcaaatttctttcccttcttcgcaagattctttaagccttcataagcatctatattcataggaaaacagaaatcttgaaatttaaggctttctacattttcctttaataaaggaaaagtcacagagcttttatcaaataaataaacttcacttgcccctctgcttgccgcttctaatccaaggcttcctgtcccagcaaaaacgtctacaactactgcctctggtatatacatttgaactgaactaaacatagcctctttaactctatctaatgtaggtcttgtttccattgtagctggaggtattaatttatgtcctcttgctcttcctgctattattctcaaaattttattcctcctaaaataagcatataagaaaatctactctctagatttttaatttacaatttaaaactaaactcagttgcacactccgtgctcttttcatatgtgaaaagttcccaattaagcttcacactctttttaaagtgaaataatcttggttgcacttcgtgctcttctcatatgcaaaatcatcttaattgcacttcgtgctcttttcataggcaaaatgatcttaattgcacttcgtgctcttttcataggtgtatattttatatattaacatatctatacataatatttcaaattaattaaagcaaatatatttactacttttttccaaatttttactaagttcattaattatttccctatttacctcaaattcgttttgtaacatgttattcgcctctaatttagcacatcttaaaatcttcatatcatcataaagatttgcaagtacaaagccttcatcaccactttgcttcttaccaaacatctctcctgcacctctgagttctaaatctttttctgatattagaaatccatcactacattctgtcattatctgcatcctctttttagtcacattacttttagcctttgctattaatatacaataagatgaatactgacctcttccaactcttcctcttaattgatgtaactgcgacaatccaaaccgttctgcattttcaacaatcattacggatgcattgggaacattaacgcctacttcaattacagttgttgatattagaacattaacttcattattcttaaatctttttattatttcatctttttcagagcctttcatctttccatgaagtatttcaacctttaattccttaaaaattccactggtaagtttattatataaagtttctactgaatttaactcctctttttcatcctcttcaataagagggcatacaatatatacttgtcgacctttttttatctcatcatatgccaaatcataagctatatctctttgattatcagcataaaatctagtatctattttctttctcccaggtggcagctcatcaattatagatacatcaagatctgaatataagtataatgccaatgttcttggaattggagtagccgtcataactaagcaatcagccctttttcctttgtttataagtttactcctttgctcaacaccaaacctatgctgctcatcagttactataagccctaactttccaaattccacatcatcttggaaaagtgcatgagttcctatcactaaaattggttctttagttctaattctttctttgatcctctgcttttcttttactgaagttgttcctgttaataattcgatttctatattaaattcatcataaactttccttgcttcttcaaagtgttgatttgcaagaatctctgttggagccataaatgcacattggtaatcatttttgatcacattaaaaatagctataagtgcaattattgtctttccactaccaacatctccttgtataagtctattcattgatgaatttgatttttgatctctcaatatttcacgtatgactcttgtttgagcattagtaagaggaaatggtaacttctctttaaataagctaagttcatctacccactgaaaaagtataccatttttgtttttcttaattttatgtttaagaagtagtaactttagtgaatatgtaaataattcctgaaatttaagccttattatagccttttccagcacttccttattatcaggaaaatggacgcttctaatagcttcatttaatgaaatcaaataatatttatctaatatattttgtggtaaattctccttaactgtcatcttggacaaaatttcattaattaatttttcaaacaacttattgcttatatcaccttttaaaggatatttaggtatgatctcattagaaatagcttcttcacatgtgaccataggattaaccacctctaaagtatttcctacccttttaaatttacccatcaaattatatatttctcctattttaaaggagttttttatatacctttgattaaaccactttccagatactttatgtccattatagtcaaattctacagttgttaataatttaccagttttagtttttacatcgcttctaaatctaatgactttacactttaaaatctgcttgtcttctcctgtaatattttcaaattccacattactatctacaaattcataatctcttggaaaatataacagaatatctagtatattaaaaattccacatctatttaatttttctgtggcctttgggcctactccttttaatgttgaaatattgctatatatatccaaagcccttctcttcctccctaaataataagagcacctagcattaggcgcccttactatttcttattctactgatattaaaaagtaatatagtggttgatttcctttgtaaaattgaatatctaagtcgtcgtacttttcttgtagctcaacttcgaattcatttgcatcttcatcacttacatcttcaccataatatacagtaataagttcactttcatcatctatcatatcttctagaactttaccggcaacaaccttcttgtcttcgcctacctcttttattttaccttctacaagtcctaacatatttccttgtttaatatctattccatcaatttctgtatcacgtactgcatatgtcaccgaaccagttttaactacttcaattgcatcctttaaattagtgaaattttcttcaacttcagaatcatggttaaacattgtggcacatgctattccttgaggaatagttgttgtaggtactactaatatatttttacttgatatttctgccgcctgatttgctgccataattatattcttattgttcggcataatgaaaatatgttcagcatttattttctcaacagcatctaaaatgtcctgagtagatggattcattgtctggccaccttcaatgacatagtctattcccaagtccttaaatatatttgaaattccatctcccatagcaactgttataaagccatactttttcttttcaccatcaccaacttcatcttcagatgaagtttctgttaattccttagtatttattaatagctctctgtgctcttctctcatattatcaatctttatctttgataattcccctatagcaactgcctttgataagactaatccaggatcattagtatgtatgtgcacctttataacatcatcatatccaacaactatcatggaatctccaaggctctctatctcattttggaaatcttgtgcacgtttggcgtcaccaagtattataaattcagtacaatacccaaactttatatcaatttcttctgtagattcagctaaagtaccatttgcgccacttatttttatatcacttaattcagctttaatatcattctttaatgcttcaaacatacctctaagtataatgtaaagccccattccacctgaatcaactactttagccttttttagtgcaggtaataattctggagttctatctaacatttctttcgatttaactgttatctcttccataaagccaaccatatccttagcatcagatgacactgctgcttcagcagcggctctaattacagaaagtatagtaccttcagtcggtctcattaccgctttgtatgctgactttgatccctctgaaaaggctactgcaaactctttaatatctacttctttttttccttctaggcctttagaaaaacctctaagtatttgcgataatataacaccagagttacccctagctcccattaaagcacctttagctaatttctttgatatttcccctatagaatcactatccatatcttctatctctttaactgctgccttaaacgtcatagacatattagttccagtatctccgtctggaacagggaatacgttaagtgcatttacgaaatcactttgctctagcaatttattgctagcattcacaaccatgttataaaaatcatggccatttatctttgtatattccatttagtttaacctcctaaactctaaccgcttgcacatttactgttatggacgacaccttaagtcctgtatagttttcaacactatagcgtactttttgaattatattattagatataaccgatatctttgttccgtattcaaccattacaaataattctatttgtaatttcttctcgcttgttagctgtatctttacacctttactaaaattttctataccaataagttcccaaaagccttcactggcatttctagaaaccattccaactactccataacattccattgtggataatccaacaatttttgctataacttcctctgaataatttatattaccattttcgcttgaaaatccaaccatccatattcctcctaaattcttatatcttattttctattctatatttacatcttattttctattctatattagaacaatattttattcaagtattcaaaaaatatacacctttaaaaagagcacgaagtgcaattacgatcatttacctctaaaaaaagcgcgcagcgcaattacgatcatttttcctaaaaaaagtacaaattaaaatcaagatcacaaatttataaaaaagcacgcacatatgaaaagagtgcaaatcacaattcggaacttatcaagagtaaccatgatcctttccttaaaaagtactaactccagccaagatcatttttccaaagaaaagcgcgtagcgcaattaagaccatttccctttaaaaagagcacgaagtgcaattacaatcatttacctttataaaaagctcaaaccaaaaccatagtcatttcaatcaaaaaatcatgcacatataaaacaaatccaaaacacaacttgaaatttattaaataaaactaaaatctattgactggaaaataggcatgagtttcaattaatataattctactttcagcaaatataatgtacatatatatcattttccctctcttaaaatacacagcataaccaaagatctttttacctttaaataaaacattcacatacaaaactagtgccaagtacaattaaaatcttcgaactaaagctaaaagtttttctcttctttaaaaatctatctctacaaagtctttccttccaaaaagtttttaaaacataatcaagagaataatttacctatgaaataaatatatatattgcaaaaataattcttcatcataattctaaaaatatttcaagaattttggccgtaattgtgaattgtgaattacaacataatacatatcaaatttcggcaggtattcacataagtttcattttcgctgtaaagccgcatattaactgccaatacataatttttaatttataattaataatttatcttgcctattacattttcctatgatataatttacactgtcctattgaagatgattatctttggaatataaggaggtgttttctaatggcaagaagatgcgaaatttgtgataagggtgttgtagctggagtaagctatagccattcacatcgtcaatcaaagagaacttgggctcctaacataaagaaagtaaaagctttagttaacggaacaccaaaaactgttcatgtatgtacaagatgccttagatctggaaaggttcaaagagcaatataagttcataataaaaaatgcaattgttatcccaattgcattttttatttttaaggcatatgtaaagaaaataacgagtctaaaatgccatggttatttttcatcaggcgaagaagcagatcgggctcatagcgagcctattagttcaatctgttgatgaagcatgatgaaaagagcagctatgctgcaacaaggaactttccttggcagatggacttgttattttttttgattacgcctaaagctatttagaaagcctaaaactaaattataccttatgtacttctagcctttttttctaaaaaactttattatattagatagaaacttaggtagtttaaaagctattattttcatttacaagtcctcccaaatattaatatattaaaaattaaaatgaaaatttaatccgtcttattatattaatattcagttactactcaaaatgttccacttttaaatataaaaaataattaaataagttcatgaatatttagtctatggaatgaataactaataactctcctttttcataagttatatctattggtgtatcaataaattcattacatatagctcgtggatctaataagcccaaatcataaattggtagattgtattttccaccactaatttgaagtttgcttactttatcgcttaatgcatgaaatgatatattttcaccatatttgccgtataacctcattttattttctccaaggtaaagtctattattatcgtctaatatttctaaattagcacctttttttttcgtagttagcataagtcctatatttcctagtgtatgatccattctagttccagttgccccgaatagatatatcttttctgcgcctctttttatcgcttccataactgcaatttcagtgtcagtataatctttctctggttgaaattccaagacttccttaacctttaacttcatattatctaaaatttcctttttggcagagtcaaaatcacctaaaagcaagtctggaataatattatacttataaaggcattcacttcccttatcagctgctattataaattcaacttcactaatatatttctttagtaacttctctgaaggtgggtttcctccacttacaattgcaacgttcaaattattacccccttagagcttttatattctcatcaatttccccaccattaaacactgctgaacctgcaacaatgacatttgcacccgcttctataacctctttaacatttgtcttatcaataccaccatcaacttctattaaaagccctgggttcaatctatcgctaagttcttttatctctctaatcttatctagagaataaggtatgaatttttgtcctccaaatcctgggttaacagacattatcaacaccatatccaaacttggtattaaatctttcaatacacttgttggagttcctggatttaaagaaattgctgctttttttccttttgacttaatataattaattgttctatctatatgtttatccgcctcatgatgaattgtaattatatcagccccagcctctataaaagcatctatgtaatttgatggattatttatcattaaatgaacgtcaaataccttctttgttctatttctaatagattttataactggcaaaccaaaagatatattaggaacaaaagatccatccattacatctatatgaataaaatccgctcctcctttatctattctttctatgtcctctcccaattttgaaaaatccgctgataatattgatggtgcaatctttaccatttatttttttcctcctcaattatttcttctaatgctcttacataaaattcgtatctgtatctattaatcttttcgctttctacagcctcttttagagcacaatttggttctttataatgtaaacaacctctgtatttacacttatcattatactgtgtaaattcaggaaaacaatattttaaagaatttttatccattaaatcctttatttctagtgtagaaaatccaggtgtatcaacaatatatccatctgccacctcaattaactcactatgccttgtagtatgcttacctctcccaagcttcacgcttacattacctgtttccatatgttctttgtttgaaagcttgtttattaatgttgactttcctgctcccgatggtccacaaaaaactgttatatttcctctaatcttttcttctaaccgctctatccctattccttttttagcatttataaagagaacctcataacctatgacatttattctcttctttatttcttctctttcttcttccgatactaaatctatcttatttaagcaaactataacctcaatgttattatattcacatagaattaaaaacttatttaataaatcaaaatttatgtctggattcttaactgcaaaaacaacaaatgctaaagaaacatttgctacagtgggcctaaccaattcagatttcctctcatgtatctcttcaataacgccttttccatgttccatcttaattgtaacatcatcccctaccataggttttatgtccttatgtctaaatttccctctagctttgcattctattaagccttggtctgtcttaatataataaaagcctcctatgccctttattatttttccattcataatttccctccataacttataaaataaatttatatattcttttatagaatgttaatatatgctgcaatgataaattagataactttaggtttaagattttaataagccaaatgcataaatacaactagaacttagcaacttaattgcaaaatatattaaatttctaaattagtattttctatcatagtatattttctttttagagatttaatgtagatctaactataaatatatattgcaaaaaataatccttcatcataattctaaaaatattgtaagaattttagccgtaattgtgaaatgtgcattgtgaattgcaatatatatatcatagaaggagaggcttttatgaacctctccttacttactattgatggttttgatttgatgttttaggttgagtgttgttttgactgttatttgtatcatcccatgggcctgtaggattagttgtgcctggagtattaggagtctttcctggtgtatccgtagtagtaccacctgttcctccagtatttttatcaggagtacttccatttccacccggcttagtatttccttgagtaggattattagttacaggtggatcttgtttcgcaacatatttaccaactgttataacaattgtagttccctgctccactctatttccttctcctgtttgttttaaaactttaccgttttgactctcatcttgtgtttcttgggaatttacagatacttttaaaccagcatcttgtaattcgcctgtagctgtatcttggtctttaccaactacgctaggtacttttgtagtcttaacttccggtcctttacttacaacaactgttatcttatcatctgctgttacttcagtatcttttttcggagtttgacttattatttgtccctctggtacactatcgctaaaagcttcgcttttatcactaatcttaagtccaaaggattttaaaatagtagttgcagtatctatatcatactccttcaaatcaggcattttaagttttgttgctcctccacttacaataactctaatctgacttttttctttaaccttagttccagcatccgggttcatcttaagaatagttccttctggctgatcgcttgcttcagttccaccttccactaaaactaaatttatagcttcaagtgctttctttccatcatcaacattctttcctactatattaggaacctcaacttctttgctgttagcactagcagaactaaccattttaaaagctgcaacacctaaaactattaacaataatgctaaaactacacctattgttattttcattattctcttcttgtttattccactgcctttttcatcttcatcgtcttcgtagtaataatcatcatcgtcttcatcatcatagtcatcatcttttttattaggcaacttttcctcttgctttgctatctgttcggtcacagcagacattattatagtatgatcattgtcgtcttctttatctatctttgcattaggatcatcctttattctttggagatctgagatcatttctttagcattctgatatctcttaataggatccttttccattgactttaaaattaattgatttaaactctcaggaatctttgaattaacactttttggcggaacaacttcttcttgaagatgttttaaagctatagttacagcagtatctgcttggaatgggagatttccagtaaccatctcatataatacaactcctaatgaatataaatccgttctacaatcaataaaatttccttttgcttgttctggagaaagataatgagcagatcccattattgtactagtatttgtaatagtttcagaatttgatgattttgctattccaaaatcagttactttcataactccatcttctgttactaaaatattttgtggcttaacatctctatgtattatgttgtttctatgagcacaatctaaagctttggctatttgaattgcaactgatatagctgtttcataattcatctttccaacttgttttataatatcttttaatgtttttcctttaacatattccattacaatataatttatttcatcctgtgttcctacatctagtatatttactatattattgtcagataaggctgcaacagctgttgcttcacctttaaatttttctacaatatcagggttgtcgcaaagttctttcttaagtattttaactgcaacaaacctatttaatttattgtctcttgccttaaatacttctgacattccgccttcccctattttttctaacaactcgtatctgtttccaagtacaattccatccatgctacatctctcctccaaacaacaatactgttatattatctctgccaccgttttgctttgccaagtatacaagtttattagcaatgtttacataactttctccttcagtgacgacttgtagaatctcttctttagttaattcatttgtcaatccatctgaacacaatatataaagatcatattctctgttctctaactgaaatatatctacattcacattaatgctagttcctaatgctcttgtaataatatttttcttaggatgattttccgcctctttttcacttatactcccaatatcaactagttcttgtactaaagaatgatctttagtaatcttcttaatttcattatttttaactgcaaaacaacagctatcacctacatttgcaacctgtataaaatttttagtcataaaacaagttgtaacagtagttcccattccacttaaattttcgctagtgttagaaaaagtaaatatatctttatttactttttctatagcttctacaagcaaattttctgctctactcgaagaaaaattttctcttacatagtcaacaatatttgttgcagccatctgactagcgacttctcctgcattatgtccacccattccgtctgccactacataaattttgaattcgtctctttctaaatacgaagcagagtcttcatttaatgttcgccttaacccaacatcactaactaaacctaccattttgctccccctctatttcttgggtatttatgtaacttcttctaagttgtccacatgctgcattaatgtcacttcccatttcacgtcttgtagtaacttctattccatgattttttagtatttcggaaaaatcttctattgccttttttgaagatctcttatatgtattttcttttatttcatttactggaatcaaattaacatgacaaagcataccttttaacaatttgcctaatgcctttgcatcttctctgccatcattcacgtctttcactagcgcatactcaaacgtaattcttctattagttttatttatataatatctgcaagcctctaatatttcctcaatgctatacctattagctataggcataatttcttttcttttatcattactaaatgcatgtagtgataaagctagagttatgctaagttccttatctgctaattcgtatatcttaggtacaattccacaagtagataatgttatatgtctctgcccaatatttaatgcatattcagcagaaactatttctagaaactttataacgttattataattatcaagtggttcgccacttcccattaatacgacgttagaaatcctttcattgatataatcttgaacaaccataatttgcgataaaatttctccagttgtaagatttctaactttaccttcaattgtggatgcacaaaatttgcatcccattgcacatccaacttgagtggatatgcatatggaatttccatgcttatatctcattagtacagattctattaagtttccatccttaaatcctaacaagaacttttctgtaccatctatattagatttatatacttctattatctttggcagacctacaaaaaaattttcttttagtttttgtactaatggctttggtatattcttcatattatcaaattctttaacacctttataaatccatgataatatttgttgacctctaaatgcactttcaccattttccttcatccatgctttaagttcttctaaagtaaaatctagcaaattgttcatttattcacctactattgtcttttttctaatttagtcacaaagaatccatccatattttcatttggcataatagttagagagccatctctattgtatactaagttatcttgtttaccaataaagatctttttcacgctacagtctttatgtctgctaacaaaccactcaatattttcttcattttcttctttatttaatgtacaagttgaatatatcattattccatcctcttttaaatacatccatgcacattccattatatctctttgaacttttataatttctcttaactcatttcttgtcttgttccactttatttctggtttttttcttattattccaagccctgaacaaggaacatctattaagattctatcactagatgctattaaatctgggtttaatttagttgcatcacttgtattaacttcaacgttagttatacccaatctctcacaattttcttttattaatccaagtttagattcatgaagatcatacgctaatacttttccagtgttttgaagcatttcagcaatatgagtagttttaccaccaggtgcactacacaaatctgtaactgtcattccttcttccaattctaataatggtgctataatcattgcactttcatcttgaactgtgatttttccttcttggaataacggattattttctatagatttaccaccttttatgcaaattgcttctgggcaaataacaccttcttcaacttcatattcaagttcttctaatttttcaaatacttcatcataatcagctttaagttcatttactctaacacttacttgtggaattgaatttaatccagacattattttctttgatacattttcaccatattgctttattaaaagtcttatcatccaaggttcaaatgaaaacttatatgcatattcgtcaattttatttcctacaacttcaatatcatcaggatttttagtgaaatttctaagtattccatttactaactttgaatcattttctgatatttcttttgcttcctctaccgcttcattacaagcagcatagctaggtattttatccaaaaagttcatttggtatattgctactcttaaaatatttaagatatctttgttcattaacttaagatcttttacaaagttcgaaattataatatctaatgtttttttccttcttaaaactccataaacaatttcagttaatagtgctttatctttatcacttaattctgcttcatttaactcttttgctaatacaatattagagtaagccccttcatttaagactcttcctaatatctttactgctaattttctacaattcatacgctacctctttactaatcatttcttctattgcttatagcaattaatcttattaattgtgatactgccattaatgtcgcagctacatatgtcattgctgctgcgtctaaaaccttttgtgcacttttagtttcgtcaccatatagtattcctcttgactttaatatattcaaagcccttgttgatgcatcaaactctaccggtaatgttattagctgaaaaattacaacccctgaaaataaaattattccaagtgtagttaatcccttaaaacctaataatataccaacaaagaatagcatccatgatacatttgagccaatatttacaattggcacaatggaatttcttattactagtggagcatacctttctttatgctgcaatgcgtgcccgacctcgtgggcagctatgcctgctgaagaaatagatgcacctgaatatacctccggagataatctaaggattttacttgcaggatcgtaatgatctccaagttttgaatttatcaattctattctaacatcaaaaagcccagcttcatctaacatcattcttgcaacttgttgaccagtatatccatttattgttcttacttggctatactcgctataagcgctattaattttggattgagcccaaaatgaaattattatagctggaactaataatatcattgttggatcagaaaacggataaaaatgcattatacatcaactccattattgtaagattatattttcctctatttcatgtccattaatatattgttctattgtcaaaggcttaccattaggaaactgtactctttttattaacagaacatcttccttgcatgaaactttcactccatttttgcttacatctataatagtaccaggttctttattgcttttttcttttagaacttctgtttcatatatcttcattctttcgttcttataatcagtataagcaattggccatggatttagtcctctaactaagttatgaatctcttcagcacttttattccaatctatattagcgatattcttatcaagcatcttggcataaaaagtctcatttccttgcttttctgggactatatcgccttttgaaattccctctatactttttacaagtaaatctgctcctctaaccattaatatatcatgtaattcaccagttgtcatattattagtaatttcaacttcatccttaagaatcatatctcctgtatctaaaccaacatccataagcattgtggtatttccagaactcttctctccatttattattgcccaatttagtggtgcagcacctctatacatcggaagcaaagatgcatgaagatttatacatccatatttcggtatatctaatacttccttagttaaaatctgcccaaatgccactactataataaaatctggttttagctcttttaatttctctatcaaatctctatcatcttttaactttattggttggtatattgggatttcatgttttaatccttcttctttaactgcagagtacgccattttctttcctctaccctttggtttgtctggttgagtcaaaatagcagtaacattgtactctttaatcattctttgcaaagaaggaactgcaaaatcaggagtacccataaatactatattcattatattatcctcctatcagtatttatttttttgaagctcccctacctttaactctatctataaatagagttccatttaaatgatcatattcgtgcaaaatagctctcgcaagtaattcttcagcttctatttcgaattcttctcccttttcatttaaagctctagctctaacgtaattaggtctcataacttcttctgtttcccctggtaagctaaggcatccttcttcgtctatttgagacccacttgtttctattatttctggattaataaatactagtggcccatccccaatatctacaacaaatagtctctttaatatcccaacttgaggagctgcaagaccaacaccatcagcatcatacattgtttctttcatatcttcaattaatgtcaataatctatcatctattttatcaacttctctgcatttctttcttagtacgtcatcaccatattttcttatatttcttaatgccattttgtattccccctaagtcatattgttaggattaatatctatactaacccttatttcattatatacactcttatttaatagataaagtgtatctttaactttttcactaaactcatcatcaaaatttccttttattattatctgccatctgtaattttcttttaatctagaaattatacaaggaactggtccgagaatattaagatcatctactactaattttttcaaatcggcttctaaagtatacataaattttgttaatttttcttcaaattttgaagatccaacaattaataatattttaccaaaaggaggattttccatcaaccttctaatctttatttcttctttaaatagagattcataatcctcttcttgagcacactttaaactataatggtttggcgtatagctttgaactattaccttgccttcatcttcacctcttccagatctgcctgcaacctgcgttattatttgatatgttctttcagaagctctgtaatcaggcaaatttaaagacatatctgccgctaaaactccaaccagtgtaacatttttaaaatctaatccttttgacaccatttgtgttccaattaagatgtctgcttctccatttttaaaacaattataaattgattcatgagaatttttatgtcgtgtagtatcaacatccattcttaatgctcttgatttcggaaaatattttttcacttctaattcaacgcgttctgttcctgctccaaaaaatttcacatatttactattacattttggacatacagtttttgatttctctgcccttccgcagtaatgacatatcaaatatccatttttatggtacgtcatagaaacatcgcattctggacatttgaatacatatccacaacttctacacgaaataaatgttgaataccctcttctgtttagaaacaaaattacctgcttcttatcttttaaagttgcctctatttcagccaaaagtttcctactgaacaatgataaattcttactcttcaattcttccctcatatctactatttccatatgcggcatttctttcccattagttcttttatgcatttctattagtttatattcaccacgaatagctttatagtaactttcaatgctcggagttgctgaccccataactaatttacagtccttaatttcacatatgaactcacttacttctctagtatgatatttaggattatgttctgatttatatgtattttcatgttcttcatcaattataataagtccaagattctgaagcggcaaaaacaaggcacttcgtgctcctataactaatttagctttcccttcttttactctataccactcatcaaatctttcaccatcacttaacctgctatgaaaaagcgcaacattttctccaaatcgtcccttaaatcgttcaatcatctgaggggttaatgaaatttccggaactaaaacaattgtacttttattttgacttaacatttcttcaactagtcttatatatacttctgtcttccccgatcccgtaacaccttttattagatatttttgatcaggactgtttaaaatcgtattaagacagttttcctgttctcttgtaagtttcttattactatcagtatcatatattcgagtattgtatctaaatactgtttgttcttctgtttttagtatacctttttctattaacttatttaataagtataaagaaaagcatccattactaacaatttctgtttttgtataaatcccattgttgctagctacgaaatcatataattttttataattttctttatcaagctgatcctcatgtatttcttcatttactaaaactacttttttctttttttcccttaaccccttcataattccaacaggaatcataagtcggattgcatcaataaatttacataaatactttcttcttaaaaatttaattacttccatatcatagtttgttaatatagcataatcatcgcatatatttaaaatctctttcactctataattgaaattaattaaatcatcttcctgcaatattgaaaatacaaagccttctattggtctgcttttaggcccaaaaggcactttaactctaaatcctattcctattttatcctgaagttcgctaggtactttgtatgtaaatggcttatcaatctccaaagcatcactatttataattatttcagcatacatgatatttatacctaccacctcacatctaatcttatattaacaatattcaatattagataattaacattctgattattacataaaaactaataatcagaactatttcatacttatacatctaccttcatttgcgtatcatatgtataagtatttccaatattaataaaagaagcgcaaattctagcgcttctcaagtataatatcaaataagttagttgcaattttttctttgctcatcttatctaagtaaatttccttaccttctttagacaagattattactttattatcttctgaggcaaacccagtatcacttgctgttatatcgtttgctacaatataatctaaattttttctttgtagttttgacatagcattatcttttaactcttggctttcagccgcaaatcctactagaatttgatttttctttttgcttccaagctccattagaatatcattatctctaataaattctatgcaaagctctccatcacctttttttattttttgtgtgctataatttttaggcttataatctgcaactgcagctgactttattactatatctgcttcatcaaatatgttcataacttcatttttcatttcttcatttgtagaaacctctacaacattaatatcttttggagctattattgatgttggtccagatattaatgttacattggctcctctatttcgtgcttcctttgctatagcataacccatttttccagttgatctatttgtaataaacctcaccggatctataggtgctatagttggacctgctgttactacaacatttttatttagcaaatctttattttcatttaattccattaaaactttgtcaacaataatttcaggactttcaagtttacctttaccgcttgttccacaagcaagtcttccttcagctgggtctatgaattcatatccaagtgactttaatttcttaatattttcttggactataggattctcatacatattggtattcattgcaggcgcaaaaatcacttttgccttagttgccattattgtagtcgaaagcatatcatctgctattccatttgcaactttacctattatattagctgtagcaggtgctactaagaatacatctgccttttctgctaaacttatatgttgaatctcccaagctttcggttctgcaaacatatcgcatgtaaccatattctgacttaaagattgaaatgataatggggtaacaaatttagtagctgattctgtcataattacattaacattaatatcttttttaacaagtaaacttactatttctaatgccttatatactgcaattccaccacttacacccaacactaaattctttttcattttatttaagaccttcttctaaaatttcaaattcaactgcatcttgatccacttcatttattgcaattgttaaaggtttatttgattttattgaaatctgaggttctgcaccttctattatttgtctagccctttttgatgttaaaattactaaagaatatctgtcatgtatcttttctaataagtctactactgatggactaatcatagagttgttcatgaataattccctcctttgaatctaatatactatcttttattctatctactctgcatttttcagcagatattatagcttctaatttttctacagctatctctactttatcatttactactgcataattatattttgaaataaaattaatttccttataagctgatttaaatctcttcattagagattcgttggtttcactgcccctgttaatgattctttgttttaactcttccatggatggtggaaggatgaatacaaaaactccttctcttgtgttttctttaacttttaatgcaccttgtatatctatttctagaataacatctttcccactttgtaacatttcttcaacattagatttaggtgtaccatagtaattatcatacacttctgcatattctaagaagtcattactttctatcttttctacaaactgctctttggacataaaaaagtaattaataccttctacttctccagctcttggagatcttgtagtagctgatacagacaacattacatccttatttttctccataaatcttttacatatagtaccttttccagcaccagatggtcctgatataactattaatagacctctccctttagtaatcattattcatcatcctcatcaactgccatatcatcttttgtagataatctatgagctactgtttcaggttgaactgctgataaaataacatgatcgctatctgttattattacagctctagttcttcttccataagtagcatctattagcatacctctatcccttgcttcttgaataattcttttaataggtgctgattcaggactcacaattgcaactaatctattagcagagactatatttccaaagcctatgtttattaactttattcccattttttacctcctaattattcaatgttttgaacttgttctcttattttttcaatggtattttttatctctattactttgttagtcatatttatttctgttgatttagatgctatagtattagcttctctattcatttcttgaattatgaaatctaattttcttccaataggttcatctaaatctaacgtacttttcatttggcttaaatgacttctgagtcttgttatctcttcatctactgctgccttatctgaaagaatagccacttctaatgctatcctgctttcatctatatcaacaccagataataactcttccaatctttcttcaagtttcttcttgtaattcttaggaatactgtcagctaccttttctatttcttcaacataattctctataatctcaatttttgataaaatatcaacttttaatttttcgccttctttacatctcatatcattcattaaatctaaagctgattcaatcagaggcgatatctcactaaaaatatcatctaaatcatcatccagctcttccaatgtaacaacatctggaaatttagctattttagttgtagatatatcatcaataacgttcaattcactttggatttgttttaaacatttataatactcttcagctaacttcatatttagatttgcttttccaatgttatttccatatgctttataattaataaaaacatcaactttacctctatttagtcttttactaattatctttcttatcttctcctctaaagccaacatcgttctaggcattcttatatttatatctaaatatctatgatttacgctcttcatctctatagagaaacttgactttcttccatcttcgctttgagcccttccaaagctagtcatactttttatcaactgtacacctccttttaacttttaaacaatttggagtttgcttaactaagtataatcataataaatttccatgtcaacattctgttcacaaattgttaacatttatatttacaaaccttataaaactttaaattcatttctttactagagattagtgaaaggttgttcggtttgccgtttgtcatcaatttgcttgaaatcacgcaaaaacaagtataaccaataatatttttcataattaaagatactatcttgattagtgacaagttatttaaaataattgtatctagtaaaggtacattattataaactagacagaatactcactttatataaaatttaaaggtctcatatttatgaaaaaatttatttatgcatttatagaaataccttattgcagtggttgctaattcaaataacaaatgatattttaatacgattgaattcaaaggaatatgtaacaatatttactaatttctgtgacataattgtaatattagctctttataattaaggcagataaaagctaataaacaaaattttattaaaaaaggtttagaaaggaagtaatcaatatgaaaagtaaaagcataaatagtaaggtcataacaggagccattttagcaagcctaattataggatcaagtagtataggggtatttgcagcagacacatctaatacaacaaatgatacatcaacagctcaacaccaaagaatgcaaggtaggggatttacaactaagttagatgcattagttacagcaggaactctaacatcagatcaagaaacagcaatagaaaacactctaaaaccacaaggtaatttcaatggcagagaccacaaagacatgtttaagaataagttgtcagaattggtgacagctggaaccctaacatcagatgaacaaacagcaatagaaactgcattaactaatgctggtaatgaaaaaggtggatttaaagcagctttagacagtttagtaacagctggaactttaacatcagaaaaggaaacatcaatagaaaatgctttaaaaccacaaggtaatttcaatggcggagaccacaaagatatgtttaagaacaagttagcagaattagtaacagctgggactctaacatcagatgaacaaacagcaatagaaactgcattaactaattctggtaatgaaaaaggtggatttaaagcagctttagacagtttagtaacagctggaactttaacatcagaaaaggaaacatcaatagaaaatgctctaaaaccacaaggtaatttcaatggcggaaaccacaaagacatgtttaaaactaaacttgatgcattagtaactgctggaactataactgcagaccaagaaactgctgtattgaatgaatttactccctcaaaataatattctttatggaatatatacagaacgtaacattatagcataggttcttcaacaactaatttttgcaaatagttaattgagaaaatattcttaggaatcaaagattcctagtattctataaatagcaaaagattacttaacaactatttattaaaccattgttaagtaatctctctaatataatttattttttggcaggtcggcgtatcctgcatctctgattactaagactagcgcgtgaggagccttttctcacctcaaaaaacaaaatttatttcaaaattaattataatatattctcttttaattcactatcttcaacttttattaatcttcccttatatattctagcattcatttttgataatgttattggatacatagttgcgacatatatatattgatcttctaaatcaacttccaatcctaaaagtaagataatattatcaaccttcttaactaattcaagagagtcaccaactgatctcttataattcacaccaacatattgtggatctttaatcactttttctatagtatctattatattatccttgattttttttgtgaattgcctaccatgtcttttttttatatggtttacaacacctggagaggcataaactattctaggtaaatcaagctctaagagctcacttatagagattttaattttaccaactttcttataagctttatactctcttttcataatacccctcatttatatcctttcttttattatatcccagtagtatgtatttttccaccacttaaataaaaaatcatggtaaaaaaagtgttgattttattactttacaatacataaggcatatacgagaaaaacgtgcccaagataccattattattttcattagacatggaaacagatttctcttatatctagcctattggggttctctgcctccgtgatctaagaacccaaacctatggttaagtgtgaatcacttactcatagattgcattgaggcgagccccccatgtacttgaaaataggcttggcatatgcactcgttattctcttgattctgcctaatatgtagtatcactaatataactaatttacttaactacaatataaaatcaacactttgttaggattaaattataaaaatctttatatcagattttttaaagtattatacagattaatccaccattaccttcattaataattttctgcaaagtcttttgaatcttaacttgaacatcttctggcattttatatagcttgttttgtaatccttcttttactaacacttctaaagattttccaaacatattactttgccaaagaagggctggatctgtttcaaattgttctagaaggccttttactagttcttccgattccttttctgatcccattatagggcttatctcagttttaatatcacactttataagatgtaagcttggagcacttgcctttaatttaactccatatttattaccttgtttaactatttcaggctcctcaaacttcatttccgaaagttgtggtgcaaccaatccatagccgctctctcttacatcttccaatgcatctttaaccttatcatattcacattttgcatgacttaggtcatttattatgctgagcaagtcactttctgaaccaacttctaaattacatatctcactaagaaccttatagaaaattccatccttaggtttcatagatatttttgctgttccactacccaaatcaacttcatttatggttgcctttcccataaagtcttcattttcaaaatcatttaagcagtattttatgtctcttaccttagagacatcttgactcatgttcataattatgttgaaaaaatctttttttagccaatggttacattccaatttttctaaccattcaggcatatcaatatttatttcttttacagggaattccttaagtacgtgtttaaataaatcctcaatatcttgttcttccatattataaacatccataacttgaacagttacattatatttatcttctaattcttttttcaatgccttagtttcttgagaattaggcttattagtattaagaactacaataaatggtttatttagtgactgtaattcatatattactctttcttctggttctacatagtcatttctatctattccagttatacttccatcagttgtaattactaatcctattgttgaatggtcttttataacttttcttgtcccaatttctgctgcatcctcaaaaggtatttcgtaatcataccatggtgtatgaaccattttagtttcctcaccatctagatatcctaatgctccttttacaatatatcctacgcagtcaaccatccttactttaaattttatttcatcccctaaatttatttctactgcttcattaggtacaaatttaggttctgttgtgtgaatattttttcctgagccactctgtggtaactcatcttttgctctttcctttttataagtattatcaattttaggtattaccataagatccatgaactttttaataaatgtagatttccctgtcctaactggtcctacgactcctacatatatgtccccttgggttctatcggctatatctttgtatatgttaaaattgtccacatttttccctcccatattcttttttccaatatatatatattcatgctttatttaaaatatacaaatataataaataaaaaattttaacacaattctaatcactaaatatatgattaaaatattattaaaattcctatctttaaaattaaacattaacattaggcataatcaaaaaagaataaaaaaatagtagacaacatgttcaaacataattgatctactatttttatagcgtgtataaaatatcactatatatataataattcttcataataactctgaagacattgcaaaaattttagccgtaattgtgaaatgtgaattacaacatatatatttttttaaagtaacttttcacacaacctattgaggactttaattagactacaatttactaacatttgaaaatacaaaaccagctatataaaaaatcaatcttttttatatagctggtacaaataacttgaaaataaattcctaaagtatactcatattccaatactataaatattaaaataattcactctttttgtctctattcatgagttcatcaacaatagacttggcattctttccttcaaataatcctttatagagtccatctgttataggcattgatatacctattctttccttcagttgataaaatgctctacaagcttttactccttcaacaaccattcctacttcttttaaagcgtcttcaagagacatacctttacctattagtaaaccagctcttctatttctagaatgcatagatgtacaggtaactattaaatcccccataccagttaagccataaaaagtttctgctcttccaccaagtgctattccaactctagaaatttccttcatccccctagttagtagtgcagcttttgtattatctccatacccaagaccatctataactcctgcagctaacgcaattacattctttacagcgccaccaacttctactcctattatatcgtcattagtatagactctaaaatatggtgtcataaataaatcttgaacatcagcagcaaatttcatttctttagatgtactgactattgtagttggtattctcatcacaacttcttccgcatgacttggtcctgataaaactacaactggattatctaattcttcttcaattacaaccgataatcttttatctgtgtcttcctcaataccttttgcaatagatattattggaatatctctagggattttccctttaatcgctatacacatacttctaattacatgggaaggtactgataaaactatataatcagcaccatctattgcttcttcaatactattaaatgcagttactcctttaggaattgcaaaatctttcatatacttttcgtttgttttcttaatgtttatttcgttaacaacattcttatctctatcgtatatattaacaacattatttttttctgcaagtaaaacagctaaggcacttccaaagcttcctcctcctaaaaaagtaattttactcataactattcctttctttgtctatattcaatttgtattccagttcctttgaaatcaaaactatctcttaattgattttccaaatacctttcatatgagaagtgtcttgcactttcatcatttataaagaatacaaatttaggcggtttagttgcaacttgagtcgcatagtaaatcttcattctcttaattccaacaataggtggttccttcataagtacagctttgcttatgacatcatttaatatacctgttgaaattctcttattgtaattatcatagcaatatcttgctaacttaagcactttattagttctttgtcctgttagtgcagagatgaataagtattcagcataacttaagaactttaaatttgattgaagatcctttttaaatttatctaaagttttatcatctttttcaaccaaatcccacttattaacaataaccataatagcctttctcaattcatgagcataacctattattttttcatcttgttctgtaattccttctgttgcatcaatcataagtatacacacgtccgctctttctattgcagcgtaagttcttataacactatatctctcaatttcttcttttaccttgctctttcttctaagaccagccgtatcaactaaaataaatttaccttcttctgtttctaaatgactatctattgaatctcttgtagttcctggaatatcagaaactattactctttcttctccaagcaatttattaattaaagaagacttacctacattaggcttaccaatcattgctattctaatatattcatcatcttcttcatcataaatagatttatcaaaatgcttaactacttcatcaagcatatcaccaagccctaatccttgccctgctgatattgccataggatcgcctattcctaaattataaaattcataagcattattttcatcttttaaattgtcgactttattaacaactaaaactactggttttttgctttttctaagcatagtagccacttcattatctgcagcagttaatccttctttaccatcaactataaatattattacgtcagctgtctcaattgcaatatttgcttgtcttctcatttgttttataataatatcattattctctggttcaataccacctgtatctatcatagtaaaattatatctcagccattcagcctctgcatacaccctatcccttgtaacccctggtgtatcttgaactattgaaattcttttccctgctaatttattaaataacgttgattttccaacattcggtcttccaactatagcaactatcggtttacccattaaaattcctcctctttatatttagacatattcaaaaataacaagccagcatgctagtctatttttcttcatatgcctcattaagtttttctattaaatcttcacctgtgtagtcaactactattaccttgacatctaaagctgattcaatatctttaattttaatatcatccagcattatctgctcattagaatcagataattcgtagccttttctaaacatgttattagacattattaaatacttactatttattattcccttcatctgatttattatatcagttccagttaaaagtcctgctatagtaatagtttctccaaaataatgattcactattttgtagacatcaagctgtatcttaggatttttacatttaattttattactggcttcaagcaattcattatacgccagctctcctgtaactatagaaaagcttcccttcatatttaaatccaagtcatctaaagtgctatctatggcatctctaaaacacctaaccattcctataccatcttctatttgatgataatcatcataaaattcctgatttggaatttctttatctgcgactaaataaaattcatcagataatctcacaaatggcttaccagtttctttaatatatgtatcttgcaattctttaatattattgatttcctcaatagattgttcctttgtatacgtattaacatgtttaagtccttgcctaaacttagtaatacctattggaactactgctacatctgagacttctggataaagtttatataaatcttcaattgttcttttaagttcatttccattatttattcctggaacacaaactatttgtgcattcattgtaattcctgcatcagctagtctttgcattctttcaagaacattacctgcaaatctgttatttagcatctgaactcttaattctggatttgttgtatgtacagaaatattaattggacttatatgatattttattatcctatcaatgtcctcatctttcatatttgttaatgtcacgaaatttccttgtaaaaatgataatctcgaatcatcatctttaaaatataatgtttctctcattcctttaggcagctgatcaatgaaacaaaatatgcatttgttactgcatgattttgctttatccataattcccccgccaaattctatccctatatcctcaccatattccttttcaatttcaatttcccatatttcaccactaggtttttctatctctaaaacaatctcttcatctgcagataaaaatttataatctatgatatcatttatttccttattgtttatagatactaagatatcattttcttctatcccgacttcctctgcaattccattagaggttacttttgttataatatttttcattttttcaccccttattataacattcttatctttgttatattacattaaacccttagttaagtcaacaattcatattattaaaacatgtttaacctcattataatttcataaaataataatgttttttattcataccttttaaaaaatagcttcaaaggatttcatttcttgtataaatgatttaacaaaacaaaaaatgttcttaataacaaagaacattttcctacattatatagtcctattcattcaaatcaacataagctcctgtttttgaaaagacagtccattcacatatattagtcacatgatcccctattctttctaaatattttattacaaacaacaattgagttccttcttgaagtaaactttcatctttttttattgctttaataaaagaagcaaacagcgatctatatatagtatctatctcatcatcctttttgcaaattctatatgccatttcttcatcatcattgacgtgggaatctatagatgcctttatcatataccttgcttttctttccatatcccatagatcctctgaaacctttttaagagaattcacatttttgccgattctttttgttattttacaaatatctactgcataatctgctattctttctaaatctgtcactattttcgagacagtgaacactcttctcaaatctgttgccagaggctgctctgctgcaataaacttaatacactgttcttcaattattttttgtaattcatcaactttatcatcagctttaataatttcatctgctgcttctatatcacaattctttaaacacagcatactttcatatatctgcttttctactaagtctgccataatcactaattgcctatttatattctttactttagtatcttgtgatcctcttgtcattcttccattgcccctttatacttaaatttatcgtttacacctaattacaccttagttacataaataaaatccacatcgcatactacatgtttctgctacttttaaaaatcaccacagatttgccttgattataattttctaaataataaaaaataattattaactagattcttattaaatttccgattaactactatgaatcatttaattatatgatatatttcctttatgcttttaatttatttttttcatattacattaatataatacctaagtcaagaaattcatagccaaatgataaaaatgtcctcaataaattaaggacactttataatacttataccttattcatttaaatcaacataggaacctgtttttgaaaaaatagtccattcacatatattagttacatgatctcctattctctctagatattttattgcaaatagtaattgagttccttcttgaagcagcttttcatctacttttattgagttaatcaaagtggaaaataaagatttatagaatgcatctatctcatcatccttttcgcaaaccttatatgccatttcctcatcttcgttaatatatgaatctacagacgctcttatcatagctctaactttatcgtccatctcccataattcttctgagcctttttcaaatgagcttatctttttaccaatcctctttgttatcttacatatatctactgcatagtctgccattctctctaaatccgtcactattttagatgctgtaaatactctccttaaatctgttgcgagcggctgttcagttgctataaatttgatacattcctcttctatcattttttgcatatcatcaacaatatcatcattcttaataacttgctcagccttttctagatcatatttttttaaacttagcaaactctcatatatttgcttttcaactagactagacatttttagcaactctctatttatattttttactcttgtatcctgcgatccccttgtcataattatcattgcccccttttagccaaatctacctgtaatataatcttctgttctcttatctcttggattataaaatatatcttctgtttttccgaactctataacttctccatttaaaaagaatgcagttttatcagctattcttcctgcttgctgcatattatgagttacaatgataactgtatatttcttctttaattcatccataagttcttccatttttccagttgatattggatctaatgcagatgttggttcatccatcaaaattacttctggagaaaccgccaatgttctagcaatacataatctttgttgttgcccacctgacattccaagcgcacttgattttagcctatctttagtctcgtcccaaagcgctgctcctcttaagcttttttctactatttcatctaagatcttcttattttttgtgccgtgtattctaggtccatacgcaatattatcataaatcgacattggaaatggatttggtctttggaataccattccgattctttctcttaaatatatatcatcatagtccttatatatatccttaccttcaaaaaacacttctccagttatttttacaatctcaatcaaatcattcattctatttaaagttcttaggaaagttgattttccgcagcctgaaggtccaataagtgctgtaacttcatttttatttatagacatatttatatctttaagagcctgattatcaccataatataagcataaatcttttgtttctataatattcataactatctcctacttcccactataagctttcatcaatctatttccaattaaccttgcacaaacattgaataagagaactgctattataagcacagccgctgttccgttagctatttgagcagcatcaaccactgcgccttctgaatttagcttccatatatggacagctaaagtttctgctggtctaaaaagtgaaaatgctgagctgttcccagccatacttatggtattgaaatttaaatttttagaacttaatcctgcagtatataaaaatgctgctgcctcaccaaaaattcttcctgctgctagtattatacccgttaatatctctcccatagctgtcggaactgtaagcttcgctaatgtttgccatctagttgctccaagccccaaagatgcttccttaacccttttacttgctgtatttattgcattttctgaaattctagtcattgaaggtatatttaatatactcacagataaagcacctgcaagtattgaatatccccatcccgccatatttacaaaaaccaataatccaaacataccaataacaatagatggaagtgaagacattgtttcaagggacattcttataaatttaagaataggtccttctttagcatactctgccaaataaatccccgctccaaccccaataggaattgttataaccaaagaaataacaagcatataaaacgaattaaataactgcggtgctattcctcctcctgctcctgtaagctttggattgccaaaaaggaatgacggttttaacatacttccacctttatataaaatatataaaataaatgcaccaagtaaaaccactatgaacatacttattatataaaatataactgtcgcaattttatctactttttttgcattcattataccgcactccttttctcaattactcttacaataactataaatataaaagaaatcacaagtaaaattaatgctaatgtccataatgcatcattccatggcgttccgccgacagtattagccatatccattgttattatacttgttaatgttgacattgaggaagtgatactatcaggtatctttacagtgttaccaattaccatttgaactgctaacgcttctccaaaagcccttgcaataccaagtactacacctgttaatatccctgatttggcgcctggaactattattctataaatcgtctgccatcttgtagctccaagaccatatgatgcctcaatgtgatcttgaggtattgtttttatagcatctatagataacgttgctatagttggtaaaatcattaatgataaaactaaaatccctgcgattaaagaaaatcccattcctccaaaacttccttttataaatggtactaacacagaaataccaacccaaccataaacaacagaaggtattccaactaatacttctaatgaaggtttaattatctttttcccaaatttacttgatatgacattcacaaatatcgccaaagcaatagcaataggtgcacttataactactgcacctactgatactaaggttgaccctaagatgaaagcgagagctccaaaggaaggctctccacccttgtttggcttccaattatttgtgaataaaaattctgtgacactatatccatcttttgtgaatattcttatcccttttgaagctataaatactatgattgatattgttatcactattattaatattccacatagccctgcaaagccttggcccaaatactcatttttaagcctttctttaaaacttcttttttccatctttactcatcccttaattgaaattattttactttcatttcacttcctgaaacaaatcctaaattatctagaactgacttatcaactttgtttgtaacataatctataaaactcttagcaactcctgttgcttcacctttagtatacatgtgtccccatgaccagaacttatatgatccatcagctatatttgctttttcagctgaaactccgtcaagttttactatttttatagcatccttagcttcttgtgtgttcatatatgcaagacctaaataactaattgcaccatcattttgtttcattgcacttaaaactgctccatttgaatcttgagttactcctaatgattcgttttctgctgatttatctccaccaagaattaccttttcgaatgttgctcttgttccagaacctgctgttctatgaactaataatattggcttatcaggtcctccaacttctttccagttagttaccttgccagagaatatatctttaatttgagctgatgttaaattatctattccaagtgatttgcttaccgcaacaccaaaaccttctgctacaactttatgatcaactaactgacttgctttatctttatctaatttttcttctgcaaaaatatctgaatttcctacatctactgatccatctagtacttgagtaagacctgtacctgatccacctgcttgagcactaatttctgcatctggattttccttattatatgtttcaatcgcttgctccattaatggaagtaaggctgatgaaccacttagggttatagacccacttactttatcgcttgattcagtctttgtacctgtttctgatttatttgatgagcttccacacccaaccattgcacttcctataactgtcactaacaaagcccctacgactaactttaacgttctttttttcattataaattccctccatcaataaattcgacataaattatgttggttaaattgtttcttattacatatcctataatatacccatttagttaatctattattagagaattgttaagttatattagagggatgttaagaaaatttaacatacctttgataataattaaaaaatgcgcaaagtttctaccactttgcgcattatctgttataaatatggaattttcacttcaaaacacgttcctactccaagctcacttttaacataaatctctccgttaaaaattttaacaatatgttttacaattgctaagccaagacctgttccaccttttttccttgatttatcaactctataaaatcgttcgaagattcttgatatatcttcctttggtattcctattccattatcttttactcttaagcaataatatttatcttcattataacttaacacttctacttttccagaagtatccttagagtattttattgcattttctattaaattcaaagctagttgatgaaatttatctctatctccaaagatcttttcactattgttatctttaaattctaatttaatatttttattaatagcagtttttctcattatattaattacttcttcaattactgatcccggttcgaactcatgcatatcaaccgctaagttgctttcaatattagataacactaatatatcatttataagtcttgataatcgttcagcttctttatctataatatctaaaaatttctctcttgtttcgtcatccttaacaaattttaaagtttcagcaaatccctttatagatgttaacggagtcttcaattcatgagatacattggcaacaaactggcttctcataagttctactctatttatatcagttatgtcttgaaaagttataacctttcctacgccttccattccatctaccatagctgatttcttaattttgaaatccctttctattggatgacgtatttttatttctttatcacttacatcatcttgttctaagaattttattatatcataatcctttatatggtctaataaacattcgcctacaatattttttttaatgccaagtaaagattctgcacacggattaattgaaattaccatattgcaattatcaacagctataactccgctttccatactttttaatattgattctattttattttgattatctataacttcacgaatctttatttgtaactgttccgccatattattgaagctatttcccaaagtcccaagttcatcatttgtattgatattggctcttattttatagtccccatgagtcattttcaaagttacactttctaactctttaactggatcaacaatttttttaactagtcttaatgatagaaataaagaaaatggcataaccacaagtaatattccaaaacaatatttaatattttctttaagtattatagtaacagaatttatgcttacagaacttctaattacaaagttattgctaagcctagtagcacaatatattaagtctgacttaattgtctcgctgtatctctttgaatacccttcaccagtttccattgctttcttaacttcttctctatccctatgattttcactactcttttgctcattatcgtataagacaactccattatcatttataagagtaaatcttacttctataccatttattttcgtattatttaatgcttttaactcttcataatcatttctactaatatcagtaacatcattaagttcagaaactagcaaatttatgtttctaagttgttcttttgtatttttaatttgttctaaatttattattgtgataaaagaagatgctacaattaatagtgcaaatagcacagttataataactgaagttaatattttgtttttcatttttactccgctgggttaaatctataacctactcctcttatagtttcaataaatctcggatttttatcgtcttcttctatcttctttctaagatatcttatatgaacatctacagttcttgtttctcctatatactcataaccccaaatcttatctaatagggtttcccttttgagtattcttcctttattctttattagtatttgtaaaagttcaaattcttttaaagttaaatcaacctttctatcattcacatatacctcatgacgttcaaagtctactttaagattttctgaattataaacatcatcttctgcctcattaaatgagcttgttcttcttaaaactgcctttactcttgcaagtaattccctgaccgaaaatggttttgttatataatcgtcagctccaagttctagcccaagtatcttatcaagttcttcgcctttagctgttaacattattattgatgtttttttcatttcagaatctctctttatttccttacaaacatcaaatccatccatacctggcagcattaaatcaagcaataacaagctcggcttctcagccttagctattttcactgcatcaataccattattagcacttaaaacctcatacccagcattaactaaattgaaatgtaataattcaactatatgttcttcatcatctacaattaaaattttttcattagccatatttcatcttccccttaacgtgaaataataaaagaaaacattctaccataggaaccctgagattttctgtatgaatgcaatttaatatcactactacaataagtacataaatctaaactatttatattactctcatttattccagatttccttaaatcgtctattatgcacgcttcaagattaagattatttccattaaatagctctttttcatttattgtatctttcttttcaataaacttctgctttaaatcttctgaaacttcataacaacattttctaatatgtggtcctatataagccttaatatttcttacatcagatccaaattcatttttcattttatctattgtcttcaatgtaatagactcaaaggtacctctccatccactgtgtatcgcagctgtaacctctttttcctcatctaccaatataaccggtacacaatcagcagtaaaaaccccaataataacatttttttcatttgttattattgcatctccctcttcatctataatatctttcccattaccttcatattttaatattctatcactatgaatttgctttatatatattatattatctgcattaaattctttttttaatgaatttaattctctaactccctcttctgtatttctattaaaacttcttcctttttctgcatttgtgaatataatttcaaattttttaccatttattattgtaaaatcatctttaatttctaagtctttcaactctaatgtattcactctaatcctccaataaattaatacttttttaataatgtatatgaaaataaaagtcacaaagccaccatgaaatcttcttatatacagctagatactttttataagaataaaatgcttgttccatttaattcattttaattctttacttaatattaacattttattagctgcttggcatctttattaactgaagtttaacttatatataacatttttcattataaaaaggacattgaaaacttttcaacatccttaattatgtgattatgttctaagattttttatttcttctaggaaagtatctatatccttaaattgtctataaactgacgcgaatcttacatatgatatttcatctaactctttcaatctagccataaccatttcccctatttcatttgatgggatttcagtgagcatactattagatattgttttttctatatcatatgctatttcttcgatttgctttctagatatgggtcttttttgacatgcaataattaatccgttaattattttttctttgttgaaattttctctagttaaatcttttttaattactaggattggaaaatcctctattttttcatatgtagtataacgcttattacattttaaacattctcgtcttcttctaattgttgtattgtcatctgttgaccttgaatcaacaaccttactttcttcaaatccgcaaaatggacatttcatactttcattcacctctttgctttcgtatatcaaaacctatacttattataactatatttttgaaatatggctatacattgtttgcatttactttttctttatcttttgccttcaccaatataacatctgttcctatttttactatatcgctccacaaaatctctttttcatcttcttttgcaaaccatgattttatttctcctggtaatattaacgcaactattttattttcatcgcagtctatcttaaaatcttttataaacccgattttagttcctgttaatatatctataacttccatacttctcatagcattgagtgaatgtaattcaagttccataattatcccccaccattataatattattaaactctcattcttatacgtgttttctcatatgctttagtgctgttttttctaatcttgaaacttgtgcttgtgaaattccaatttcatctgctacttccatttgagttcttccattgaaaaatcttaaattcaatataagcttctctctatcagtaagttttttcattgcttcttttattgaaatattttcaagccaatgttcatctgtattttttgcatcacttatttgatccattacataaatggcatctcctccatcatgataaattggctcaaacagtgatacaggatcttgtattgcatctaacgcaaatacaacttcttctcttggcaattcaagttcttttgcaatttgcgatatagtaggctctttattattgtcttttataaatttttctctcataataagagctttataagctatatcccttaaagatctacttaccctaatagaattattatctcttaggtatcttctaatttccccaattatcataggaactgcataagttgaaaatttaacattttgagacaaatcaaaattatctattgatttcattaagcctatgcagcctacttggaataagtcatcgatattttctcctctattattaaaccgttgaataacactaagtactaatctcaaatttccctttataaaagtttctcttgcgttcttatctccagcttgcatttgtaaaaaaagctgcttcttttctttttctttaagtatagggagttttgaagtattaacgccacatatttctactttgttaattatcacaagtattcaccccttcgaaagtaataatccattgcattaaacattatctccgataggcaatacttttatacttgaagacaagctaaatcattctacttatttcttttttcaatcttttaattatttttttctctaatctagaaatgtaagattgtgagattccaagcatatccgcgacctctttttgcgttttttctcttgttccatttaaaccaaatctaagtcttactatttctttttctctatcatttaagctctttaatgccataactaatagctgcttatctacttcatcttctatcaaattataaacagtatcgttttcagttcctaatatatctgataacagaagctcatttccatcccagtcaatattaagaggttcataaaatgatatttcagcttttatcttgctatttctccttaaatacataagtatttcattttctatacatctagacgcataagttgcaagctttatctttttttctggattaaaagtatttactgcttttattaatccaatagtaccaactgatattaaatcttctacatatacacctgtgttttcaaattttcttgctatataaacaaccaatcttaaatttctttcaattaaagtacttcttatattttcatctccaccatttaatttatttaccaaatcttcttcttcatcttttgataatggtggtggtagagcatcatttcctcctacataatataatttttttctaaacaacttgaacttacataataatttattaaaaaacagaactaacttttccataaatatcccccttatagactattccccttgataataaggcattaaattcgcattctttacttaatttttctttacatggacatattattgcatcgacttcttcatatagatgataattattgcttatttttatgttgttaacttttatacctttaagacttcctccatatcctattgaactgtaaagcacatgatatgtattgatactattaaaatccacatcacttattaggttttcttcaattaaaatacatggaagatttgtaattggctctctaagctcatttccagtatctaaaaagcttttaatactatattgcttgccttctatattgaattcaatctcaaaaacaaaattccttacaaacagcttgtctctaatgtattccacaagtctgctaaaaattatatacataatcattactcctagcataatatatttaattgaatacttctctattttgaatgtagttcctaataaatataaattttgctttaatgaaaatagaaaacatactccacttaaagtaaatgtcatcattagaaatataataagaatcttgatcatattaagaatgtttgtttttccatacactattctgagcattatgaacgcaacaattaattcaataggtaaacaagataatatgtttaactgtggaataactaaaaccaatgtataaattccacccaataaactggagcttaagagcgcaatcaccttacatttatgctttatgcatttcatagttactgttaacaaaaagaaatttactatgcaattttccaaaaccaaggtatcaacataaatttccatctcaacgcctccagtctgtctggattttattatatacttctttctcataaaaatttgtcacaatcacattaaatctttttgtttttttaattgaactttttacatttatttacactatatttttttgtactcttttttatatttaaaactaacttaatatgtaaaaataaattcttttatcttatataaatttgctaaaaataagtggaataaaattcaagtgattctattctaaatttaattatgtaatttaaatttagaaatacccaactttaaaactaaatttatatgataacttaccgaaatcataaatattttgattccgaaaagctatgaaaatatctctgaaggttctaagcagcaggtggctcgatgtaactgacaagtttctgataaaaatacaatatactaaaaaataaaaaaaaaaaaatagaatgaaaacttgcatatcaaaggtcaaaaaactatttaatagttttttgatccctaaaacaaattttcattctatttaactttatttcttaatattataaattccgttattaatgtctcttttgtcttcttaagaaaacaggtatatctaaatcatctggctcataattgttagaagtcatttctggttcttttgcatctactgcaacttcttgctgttcttttgcaacttccttaacttgaggttgaacttttttagattcttctactatagaacctaatgataatctgttattttcactttcaaatccagttgctataacagtaattctaatttcttcattaagagtttcatctataacagctcccacgattatattcgcatctggatctacagcctcacgaacaacatccgcagcatcatatacttctaatgctccaaggtctgctcctccagtgaagtttataataacatctgtagctccatctattgatgtttctaaaagtggagatgaaattgcttgtttaacagcatcttgtgtcctagtatcacctttaccgaaaccgactcccatatgagctagtcctttattaagcattactgcttttatatctgcaaagtcagcattaattacacctgttattgtaattaagtctgaaatagcttgaacaccttgtcttaagacttcatcagctaacttaaacgaatccaacagcgttgttttcttatcagccatattaagtagtctttcattagggattataactaatgtgtcaactttttcttttaatgttgctatccccatttcagcatgtctcattcttcttttaccttcaaaagggaaaggtttagttactactcctacagttaaaatctccatagatttagcaatttccgctactattggtgcagcacctgttcctgttccgccgcccataccagcagtaataaacaccatatttgctccctttatagaagctgttatttcttctctgctttcttctgctgctttctttcctatttccggattagctccagctcctagtcctttagttagcttttcacctatttgaattttttgatctgcattagaaagcataagtgcttgcttatctgtatttattgcaataaattcaacattttttagtccttcaactatcattctatttacggcattacttccgccgccgccgcaaccaataacttttatattggttaactcttgcatatctgtctcaaaatctaacaaaacaattcctccccttaaaaaatcttatcaaaaaaaactttaactttttttagaatatgattttcaccttcattattgtgtaaatgttctttttcattaattactttattatcattatgtttattagttagaattatattatcatcctctaataaatttaatctatcatatacttctttagcaatagccatagaagttatattttctgaattttttattcccagatcattttttcttataactttagtttttattttgaaaattttacgaacgatttcatctatatcttcaaaataattaactccatctccatatagaattatactacaaattctatcataatgaccagtattttttaattttatattgatatggcttaatatttcttcaattctatcatttaccacttcatagaataatttcctggaaactttggtagttcctacctcaatttcctcttcaagcgaattatctagatataaagctttataattgctagagtaaatctttttcatattatctgcttttaaaaacgaaaacttcccacaaattgctaaatccttagttatatttcttccacctattggaatagaatttatgcttttaggaattccatccgtaaataatgctatatcagtagtcccagctccaatgtctgcaatcactatactttccatagaatttttttcattcaaaaacacttgctttcctactaatatattcaattttatagacccaatattataccctgtttttctaaaaagttcataatatttttctatttcacttttagctgctattactaatgtaagatttatttcaagtttacttcctttccaatttaatatatctttacgtattactttgttatctaatatataaaaattgataagcacatctactatacattcatcgtcacttaaaataaaatctctttgtgcatttttcagcgcttttcttatatccgcacttgtaactttttcttgaatattaactacagttgatacttcagtaattcttactttattagaagaaattccaatggatattctttcactttttactgtcgtctttttttctaaatcctttaataagcttactgcaacatccctgcatttatcaatatctaataacaaacctttctctatacctgctgatttgcatgattgaactcctaaaattttaagttcgtctttctctctaatcgctacagtagcagataatttttgagtaccaaaatctaaggacgtaattatctcttgttgcatgattaaatctttcccttctctgcagaaaaaaatctactaattgcaatatattcaacacatttactcaaattcctttttttatttatgcaattattattttttatttattatttcgtatccatttttcatattcttccctcgatatagtattattacttactaatcttttcaaatccatctcaatagtctgcattccaaatttagagcccatttgaataaagctgttaatctgctcaaaatttccttctcttataagattttttatactagaggtacataccataatttccattgcagcagttctaccctttcctgaagcatttggcaataatacttgcgaaacaactcccctaagcaatgatgatagttgaattttcacttcattttgatggccagattcaaaagaatttataattctatatatactatttgctgctcccatattatgcaaagtagaaaaaaccaaatgtcctgtttgcgcagctcttaaagctatttcaattgtctcaggatctctcatctctccaagcagtataacatctggatcttgtcttaatgctgctctaagtcccattgcatagctttttgtatcttgtccaacttccctttgatttaccattgatttcttcgtttcatagatatattctattggttcttctaatgtaattatatgcttttctttagtcatatttatttcatttaccatagccgcaagtgttgtactttttcctgatcctgttggtccagtaacaagaaccaatccatcttgtaattcagtgaaatcctttaaaactggtgcatctgatatatccctaagctttggtatagcttcctttataactctcatacatatagcataattacctttgcatttaaatgcattaaccctgaagttccctaaaccaggcttattatatttaaaatctatttctccattttctaaaaactcttcatatttacttggcattagatctctaatatattctccaacaacttcgtgtggtactgcattttcatctgcgataaccaaatcaccgtctactcttaccattggtggcaattctgaagttaagtgaatatctgatgcgctagttagatcaattctatctaataagttgtctattttagccataagttttctcctctatctgtaatttaaaaaagtaaattattagtatatcttataaaaaataaggtgctatattaaaaatagcacccttttttaaagtatgtcaatattctttatataaatatagaatatttatccttccaacttcttttaacattacactaatatgaatgaaaatggatattattaagtacatattatatactaaatagcagcgcatcgctttatagtgataaagatttataattctctatacactaaattaatttttagtaaataactctttttttaatttttttaaagcttttttttctattctcgatacatatgatcgtgatattcctaaatttactgctatttctctttgtgttttgcattttccatcaattaatccatatctcattattataatagcactttctcttttggttaatgactcaatcaactttttatatagagctctaacttgtaaattgctttcaactttttctaagacgctatctttttcactgcttagtatatccataagacaaaattcatttccttctttatctactccgattggatcttggagataaacttcacttttttgctttttactatttctaaacagcattagaatctcattttctatacatctagaagcataagttgcaagtctagtacccttacctgcatcgaaagaatcgatcgcttttattaatccaacagtaccaattgaaattaattcatctacatccttattaggaaacgaatatttttttactatatgagctactaatcttaagtttctttcaattaaaatacttttggcatttttatctccttctttaaattttttcaaatacatttgttcttctgtttcatctaaaggtagtggaaatgtattattatttgttacatatccagttaagaatagtgaatttaatattaggtctataaagctatttaatataaacacctttttcctccatagcagtgcttgatattataatatgttggagtaccaaaaaagttgcttatacatttttattttttatatttatattttactatataggttctaaatgatataattcactcttaataaagttatttggtttgtagcgaccgatattccaatatatgttcttattaattaatctttttagaacacttatattgcaattaaatttctatatcacaagcttaatttaccacttagttcactagaattctaaatgtaaatttattatctcactatatataatatagcagtgattaaatttcactacttcgcatttaaagttttaactatatctttaaatattggtgctgcagtatcgccaccaccaagatcttcattattagcatccttatccatctgtatgtctggggtaaatactaccatagtatagttttttcctcctgcactaaaatatccagcaaaccatccatgagttttaccttcactacctgtcgccgaaccagttttaccacctatatcaagatctgattcatacgcttttattcctgttcctttcaaaacaacctgcctcatttcattcttaactatttttgctgttgtttcactaaatactctctttttatcagttttaaactcttttattaaattatcatctttatccaaaataccttcgactaagtatggcttttcataaaccccattattagttatggaatttatagctcccagcatttgaattggagttacattcatgcattgtcctatagatatattatttattccagactcctcttctggtttcaccccttgtgcctcttttacaattccactatttaaatttagtactctatcgtataatcccaatttctgtgagtaatccattaatttatcatagccaacttttgctcctatatcagcaaatacatcattagaagacttttcaaaagcctgctcaactgataatttaccatatacttttctatctatcttacctgctccaacaaaagtatcatttatatttataagccccatatctaaagccgctccgagtgttatcactttataaatagatccaggctcatatccaatctgctgtatacctaaatttacattagcagcactttcatccttttgaaccattgccctaattttacctgtatcactttccattatagtaacccctacattgcttaaatatgaatattcctctttatccaaaatatctcttattttattttcaatatcactatcaagagttaattttaaatttttattatcatcacttatacttactgattgtttcgcataaacagctttattatctaaataaaattcgcttttaggtttttcattatcttttagataatcatacatatcaccttcaagagttcctacttcatgttcctcatctaatatttttgataacatactgctgacactccacgcttttttagtatctacttcatcagaaatataagtatatattccttttatattttttaggttattaattttattatatgtatcctctgatatgttaaaatataatttcccactttgtttcattatatctgaataactaaaatcaggattttcagatttcattatgaaattaaacgccattaaatcctcaagtgtttcttcatagttatttaaactgaatggtcttgtatcaatgacaagtacgtattttttgttatacttcattaaatctttcccattagtgtctaaaatcatataattcatattgctaatattttcttcttggtgattttgataagaactcacaactctttcagatggatatatttgcaatattgttaaacgcgctgttaacataacaattacagtcataagcatagctagaatctgaattaatctcttatttctatcaaatttttcagtaaaaatgaaaaacacctccctctctagcttaaattctagccttaaataaggtgttttattcaaaatatctggacttatgcaataatccaccgaaagtaaaaacattgttatttcacaggactatgaaaatttcgctgaaagtgctaaattgtaggttgcaccactaatgcttgctcccaatttcattgtgacaagcattagttgaacaacctacaattgagagattttaacagctcattttcaatgcctgttgcataaaaatgtttctactttctagtatggtatttattgcaaagtataaatcaaattcttaagttgtttatccatatagatatccaactctaaatctaaatttatgtgacaacttaccgatatcaaatacacttgagatttataattaattagtaccataaaaattttgcttaaaacacaaaacgggagatttcacccactttagcctactccaaacgtaaaatttggataagcaaaagaggaacaacctcccgttaaataaactattctttgtctttaactattaaatctttttcttttagtggaatatctactcttactttgtatatcattttcgctctatttgccgactctattggagttccgttttcttctgtcatatcatgaagaacaacttcgaaattatctccttctggtcttaaaacttctactgtatcaccatttaatactttatttttttgttcaatagttgctatttttgtttcttcatcgtatgctcttactattcctattatatctgcatgccttatatacgctgaatcttcgtatacttgctctccactctggccatagtaaaaacctgtatgatatactctgtgacttactttatttaaattttccatccactttggatcgaatttataattatcaggatctttcatatatgcatccactgcctgcctatatgatttaactactgctgcaacgtaatataaactcttcattcgtccttcgatttttagagagtatactccagcctttataacatcgtctatatgttcaatcatacataagtcttttgaattcattatgtatgttccattctcatcttcaactactggataaaattcatttggtctcttttcttctaccaaatgatatttaaatctacatgcttgcgcacaagcccctctattagcgtctcttccaaccatataattagaaattaaacatcttcctgagtaacttatacacattgaaccatgcacaaatgcttcgatctcacattcctctggtaagttatctctcatttcttttatctcagttaagctaagctctctagccattactattctcttaacaccttgttcataccaaaacttagctgctctccagttaacattattagcttgagtgcttaagtgaatctctaaatttggtgcaacttctctagctgctgaaattattgctggatctgatgctattattgcatcaacacctgtttcatataattcctttatataatcttctactccgcctaaatctgcattatgagggaaaacgttcatagttacataaacttttcgatttctatcatgagcgtattccacgccttcctttaattgttcattagtaaaattatctgcaaatgctcttagatttaatttgcttccgccaagatatacagcgtctgcaccaaaatctattgctattttaagtttatctaaatttcctgctggtgctaaaatttctggtcttatcattttaatttacctcctctttgtaactgcaattccatctcccattggtataacagacgtaattaagttttcatcttgagtaactaattccaaataagtcctcattctctttactattgtaatttttcttcttttaactaattcttgtgatgccaccatacctctaaataaaacattatcagcaactattaccccatctggattaagtagtctcaaacagtgtggcaaaaagtggttgtaatgtcctttgcctgcgtccataaaaatcaaatcaaaaggctcatttaatttttctaaaatctctaaacaatcgccctcttcaattttaatcttatggtctaaattaaatttctttaaattaatgtttgcaagttcaatcattttttcatcacgttctattgtaacaatttctggttctgttccagcagcttgatacattagtattgatgaaaaccctattgctgttccaagttctaatattctttttggtttcttcatactagtcatgaattcaagaaatacacctgtttctttttgaacaataggcaccccatttgctcttgcaaaagcttctatttcctttaatgtcccttctctctcaggaattaaacttctaatatattcttccatatagtcatatgtgatttcgctcatgaatttcctccataaatctgtattatagataaacaaatcaataacttgatttataatttatatctaattcttaagttgtttatctatagataagcaatttaagaattttacttatgcatttgattagttcttcaatttacttgagttagattgggtatatgtcaagttcttgttttggaaatctatacatatccaaaattaagtctctatattatactttagaacttaaattatcaattcacatctatcgattgtgcattgtacattgtgtgcattacagttagtatcccaactcttttttcttatttaaaaaatcttcatagttattagtaaaataatgcgatccatcatctttcataatataatataaataatctgtcttttcaggaagcaatgctgccttaatgcagtctaaacctggatttgctataggaccaactggcaggcctttatacttatacacattatatggagaatctacttctagatgcttgtttaatactacatcaacatgatatcctaatgcataaattacggctgcgtctatttgaagtttcatatctttctctaatctgttgtaaataactgatgatattaatggcctatcaccaggcactcttgcttctctttctatcatggaagctatagtaactattttttcaacatcttcatcacttatttcaactttagtctcatcttctgcctgcttcagcacatcttcaaatctatctaacatagatttaattacatcatttgcatttgaccctttttctattaaatatgtatcaggatacaaatatccttccaaattatatctcttcttattattatttttcacgaaactaggcaatttataatctttaacgtctttaataaattcgtctttagaacaaatacctttatcttctacgcttttagcaatatcttctatagaataaccttctggtatagttaatttaaccagatccttatccccatccttattttctaaagattttatcagttcttctaaggatgaatttgtatttatttcatatataccttctgttaaatttacttttctcttatctatagccagatttactttaataagaagtttattggtcaatttattttctttgtctaacttatccaatatatcataaaaaccttcgccttgtttgacttcaattataattgagtcttcagtcgactttaatggttttcttatggtactactataagatattacaaacgtcagagttattacaaataaaaataatataattaacagtattagctttctaaaagatttatatttattcataaactttttctactttctcctagatataattaaaagtaaatagccaaataaagaccatttactttaattatatttattttatttaatagttaaagtattttcagcaaattattttttgtttctgctaatcattcttcttctttcagcactatccaatactctttttctcattcttatattctttggtgtaacttctaccaattcatcagcatttataaattctaaacattgttcaagagacatttcaactggtggagttaattttaatgcatcatcagcacctgatgatcttgtattagtaagtttcttcattttacatacattaatttcaagatcctctgctcttgcagaaaccccaacaatcataccaccgtatactggaacaccagcacctatgaataattgacctctttcttgagcactatataatccatatgctattgaatctcctgcttcaaatgaaactattgatcctctgcttcttcctggaatatcacctttgtatttttcataagaatggaatacgtgattcataattccattaccttttgtatcagtcattaattcacttctaaatccaataagtcctctagctggaactgtgaattctaatcttgtatatccatttactgcagatgtcatattaaccatttctgcttttcttggtccaagcttttccataacaggtcccataaattcttctggaacatcaattgttaagtactcaattggttcttccttgtggccatctacttctctaaatataacatttgcctttgaaacttggaattcatacccttctcttctcattgtttcaataagaactgaaaggtgaagttctcctcttcctgaaacttcaaaacaatctggagtaagttcttttactcttaaacttacatttgtttcaagttctttcattaatctatctcttaaatgtcttgatgttacgaactcaccttcttgacctgcaaatggtgaatcattaaccataaagttcatatttaaagtaggttcatctatttcaaggaatggtaatgcttctggcgatgatgaatctgctatagtatcacctatattagcatcaataacaccacttactgcaactatatctcccattgaagcttcttctgcttcttctctctttaatcctttgtatgtgaatatactagttattttgtaattagcgcttgatccatcattcttcaataaagcaactgtttgatttctctttactgtacctcgatgtatcttaccaattgcaattttcccaacaaatgcatttgtatctagtgtactaacaagcatttgaagtggttcatcaatatatccttctggtggtgcaacatattttaatattgtatcaaatataggagtcatatcgttattttgatcatctacattatatcttgcaaagccttctctagctgatgcataaataatttggaaatctaattgttcatcattagctccaagttctacgaatagatcaaatacttcatcaataacgtctgttggtctagcatttggtttatctattttgttgattataactattggctttaaacctaattctaatgatttctttaaaacgaatttagtttgtggcattggtccttcataagagtcaacaacaagcaaaactgaatcaaccatcttaagtacacgttcaacttctccaccgaaatcagcatgccctggtgtatctactatatttatttttatgtcattataaattactgcagtattctttgaaagaattgtaattcctctttctttttctaagtcattagaatccattactctttcttctactttttcattagctctaaatgtatggctttgttttaacaaagcatctactaaagttgtcttaccgtggtcaacgtgggcaattatagcaatatttcttatatcttctcttttaattaattccattattattcctccaaacagcaagcaagctgcgaatttttcttttatagtttctctttagtttgtatataaattagttaaaatttaagtatacactgtaaataacttcatactgttaacatattattactattattataaataaattgcgattaaaattattcacatataaatgtaaacctataactgtttttctccaaaagaaaattggatacttaaagtatccaattcctacacaactattataaattctactcttttcatcaaaaaaagtcaaccctattccaaagaatatatatttaacaatttaatatttagttaattcataatttaattatcaataacaaaatatattctttgcagttttagaatcactattttctttcacacttcaaaaaacttctaaaactccataattattggcaatatcataggttttctcttagtcttttcgtaaagatactctctaagttgatctctcatcttagattttaatgtagcccagtcagtaatctgtttttcttcacaagtctttaatacagatttaacaatttctcttgcttcatccataagaccttcagattctctaacatagacgaatccccttgaaattatatctggaccggatacaacccttccagtttgtttctctattgtaactactattgttaatataccatcttgtgaaagatgttttctatctcttaagacaatatttccgacatctccaacaccgagaccatcaacaaacacttgccctgaaacaacagtaccattctttttaatataatttcttgctacttcgataacatcaccattctcaggtattaataaattcttttctgaaagtccaacttccatagctaattcaccatgcttctttaaatgtctatattcaccatgaactggcacaaagaattttggtttaactaaagcctgcattagtttaagttcttcttgacatgcatgacctgaaacgtgaatcttttcctgagaatcatatataacttgagcaccctttttaaatagttgatttataacttttgaaacaaatttttcattacctggtataggtgttgctgaaataattactgtatcgcctggaattacattaatttttctatgctccgatgctgccattcttgcaagagcagacattggttcccctggcttccagttgttattacaacaattttttcgtttggatattttgaaatttgatccactggaacaagtacatcttttccaactgtgagatatccaagttctattgcaacttgaacaatattctccatacttcttcctgaaactgctaccttcttttcataagcttcagcagctgtaattatttgctgaattctgtgaacattagatgcaaatgttgcaactattaacctacccttagccttaccaaaaagtcttaggaaagtttcgccaacaaccttttctgtcatagtatatcctggtctttcaacatttgttgaatccgccattaatactaaaactccctttcttccaagttcagctaatcttccaaaatccatcatttctccatcaattggtgtgtaatcaatcttaaaatctcctgtatgaagtactaccccaagtggtgtatgaactgcaattgcaactgaatctgcaattgagtgattagtctttataaattcaactgaaacactatcaagtttaattatatcctttggctttactcttactaactctgttgaagctaacaaaccgtgttcctttagttttgtttcaactattccaagagtaagcttagtgccataaacaggaacatttagttgtctaagtacatacggcaacgctcctatatggtcttcatgtccgtgagttaaaaatatccccttgattttctctgaatttttgattagatatgaaacatctggtattacaatatctattccaaacatatcatcatccggaaattttagtccacagtctataataataatatcttctttatattctatagctgttatattttttccgatttcgtttataccaccaagaggaattatctttatcttcgctctttcatttttcatacttcccctccttcttcttaatattatatttataaacaaaggttctttctttagcattaaaaaataacaagtcctatgtgacaatatatttcacattaatataggcgaccttaatctacattccaatctataagcctacattgctttatttagcatataaggtttagccatattaattcactttaaatacatataccttaataacaattaccatttgataccatgcccttttaagcatggcactaaatgcattttcttagtaaatatataaaccgtaaaatacatatccttacttcattcacggcaaaatatctggcacacttttgactttattttatttttaattttctattaaaagtccttttattcatcacttagcttcttttggcattcatcacatacgccaaaaaattttaaactatggtctaaaatcttaaacttatattgcttttcaattccagattctaaatcctctaataaatcatcctgaacttccaaaaccttatgacagatattacaaataagatgatgatgtctgtgcgtttcatttgaatgcactatttcatatctactacatccatcatttagatctaatcttgatattactcctaattcttctaacaaaagaatagttctatatactgttgctaatccaatttccggacaacttttttttacactatcatatatttcttccgctgttaaatgttgaccttcattttcaataatagtatcaacaattgatcttctttgtggtgttaatttataacccttttttttcaagtcttccttcaaggcattcatatcaattaaatttgatgcatccatacatgacacctcacttttcatattaaatgaattgatttttctctaaataaacattaaagaaaatatcatattactagattgtatactattcctcaattaaaccatcttcattcataagagtttcataagtttctaataccatttcgaattcttcatcgtcatcttctaaagctataaatatatcgcttccatcctcatctttgaatatcttaaaagcataagcttcatcagtttcttcaaatgcaggagttgcaataatatattggccttttaatttttctatttcaaagtatataataacctcaaacttaacatcatttccttcttgatcaggtatatatacatattttgcttccttatccataaatgtatcccttctgtattttatttttatttatgttgcaattcacaatgcacatttcacaattcacaatcgcgattaaaattcttgcgatatttttagaattatgataaggattatttttgcaatatatatttattaataaaagcatattgtataagaaattaatcttatacatatactcctcaaaatttcctattccatcagatatttattttcttgaaatcatatctaaatatccttgaagtatgtaagttgatgcaactttatctactatcttcttcctcttattccttgacaaatcagcttcaagcattgctttatgtgctgcaacagtagttaaacgttcatcccagaatttcacttctacattaagttcttcttctataacctttccaaaagccatcgcaatctctccagatggtcctattgttccgttcatattcttgggtaatccaattacaataacctttgcatcatattcatcacaaaacttttttatttccgctatatctttttctttattagttcttctaactgtagtcaggccttgagcagtgaatcctaatggatcacttactgccactccaatagtctttgaacccaaatctaatccaagtatcctcaaattacagcacctctcacaacatataagcagcaaatatcaagaaaatctcgatatcacgctttctttcatatactaaaattaaaagtgcccgttataaacgggcactctctactttatctctaaataagattttataacttcttctagtatgtcatctctctcgagttttcttactaaagctcttgctccgttgtaattagtgatgtaagtagggtctcctgaaatcaaatatccaactaattgatttataggattatatcctttttcctgtaatgaattataaacctctgttaatattgtttttgtaagagcttctttattcttacttaaatcaaattgcattgtatgttcaatattattactcataaaattgctacttaaagcaactcacccccttaatcattttataaggaaacgatatccatatttattattaactttattttttaaatttattcactaactataattagattataacctattttttataaaaagtatactactttgctaaagtttccactattttatatgattcttcaatcgcctcttgtatcttttctggcatctttccacctgcttgagccatgtctggtcttccgccgccaccgccgccaagcatagaagatatttcttttattaactttccgcaatgagcacctttagctactgcatctttagttgccatagcacaaataataacttttccagcatttgcactcataagtaaaactatgctatttggagctttatctcttactttttcgcatacatctcttaaagtatcactatcaacgtcttttaattcataagaaattacatttatatccttaacgtttcttgaagaagatactatatcatctattcccattgatgcgaatttagattttagagctgttatttctttatctttttccttaagctccttaacttgttgatcaagtttagctaataattctttttctgagcatttaagcttagttgaaatttcttttaataaatctttcttttcatttactatcttataagcttcttttcctattacagcttcaattcttcttgttcctgcagcaataccactttcagatataattttaaataaaccaatctttcctgtgttatctatatgtgttccaccgcataattccttagagtattcccctgcacttacaactctaactttatcagcatatttatcatcaaatatacctatagctccactattttttgcttcttgaagatccataacttctgtaacaactggtgtaacacttgtaattgcttcatttaccaaatcttcaaccttattaatttcttcttctgtcatagcttcaaaatgagaaaagtcaaatctaagtctatcattacttacataagatccagcttgatgaacatgtgatccaagaacctcagttaatgctttatccaaaagatgagttgcagtatggttcttcttaatattttcacgtctaactttatccacttctatagtaactgtatctcccactttaagctctcctgatacaacttcaacaaaatgaactatttttccgcctatgttctttttagtatcaagcacattagctttaaaaccatcattaaatattacacctgtatctcctatttgaccacccatttcagcgtataaaggagtaacatcagtaactataatagctttatttccttctgttatagcatctgtaaagtcttcaccttcaattaacactttaacttctgcatttaaagtatcattgtcatatccatcaaaaacagtttcaacttctgctggtataatatctaatgttttaacatcagttcccatgtaattagaaacttttcttgcacttctagctctttctctttgaactttcatttcttcgtggaaagcatcttcatctaatgataagccttcatcttctaatatttcttttgtaagttccatcggaaaaccaaatgtatcatataatttaaatccatctacaccactaagaactttttcattctttgcttttagttcacttataaatccatttaatatttccattcctgaatctaaagtttctctaaatttatcttcttctattttaattacttttttaatatattcttttttgctatttagttctggataagcttcacttgaatctcttataacagtatcgcataagttacaaaggaatgcttctttaatccccaaagtttttccatgtcttgctgctcttctaagaagtcttcttaacacatatcctctaccttcatttgatggcataacatcatctgaaatcatgaaagttatcgatctaatatggtcagttattaatcttaaagatatatctgttttttgattttctccatatttaacattagctaattttgcaacttcacttaaaatattttctaatgtatcaatttcaaaaatactattcttctcttgcattatagttgcaagtctttcaagtcccatacctgtatcaatgttagtattagcaagtttttcatagtttccttttccatcaccatcaaattgagtgaaaacaaggttccagaattctattatcttatcttcatctgctaatttaacgaactcatcagcgttagttggtatttcctctgatctattaaaatgaatttctgtacaaggaccgcatggacctgcaccatgttcccagaaattatcttctttgcctaatctaaatatatgagttttatctacatctgtaagtgtagtccaatattcatatgcttcatcatcatctaaatatatagttacatataatctatctttaggaagttccaacacttctgtgataaattcccaagcccaaggaattatttctttcttgaaataatctgcaaaagaaaagtttccaagcatctcaaagaaagtaccatgtctacttgtaatacctacgttttcgatatcccctgttctaatacatttttgacaagttgtaattcttctctttggtggctcttgtaatccagtaaaataaggcttcaacggagccattcctgcatttattaataataaacttttatcgttctttggaaccaaagaaaagctatccattcttagatgatctttactttcaaaaaatttcaagtatgcttctcttaagtcattggttttcataaatttcataaactattcctccatttttttcagttaacagttgactccgatatccattgtgaatatctttttattgtttataatcttcttatgaagatttaagatttcataattatttgtgacaagtcattaattgcagaaccactgctctttttataggcgaaaagatcctaattgcagaaaagttccgtattgcagcatagcttctcttttcagtagtgcatagctgctcttttttataggtgtataatttaccaaataaaaaaagccctctccccaaatagatatagggacgaaagctagaattccgcggtaccaccctaattatgtatgatataatcatacatcacttagtaatttatagctcctaggtagcttcaaaatatatagccaaaagttttcaccaaccactttttctctgaaatgactatgataaatttacttatcctattcatcgcttaatatttaattatttcatcaaaattatatttcatatagataattatgtcaatattcaactttatttgtactcccctaatgcataagcttttttatagataacccaactataatctatacttatgcgtataactcaccgaaatgaataatatacttttgctgaggaagttcgagaacccaaaataaaattttgaactctcacttcacaaaccaaattagaacaaccattagcggaaactctactcacgttcgttcgctgagcaagcgattctcgccaattcaaagatgcactgtgtgaaagttctgctaaccaaatataaaattcggagcatcactttttgggttttctgctcaagtacctttaacagctcattttcaaatgttttcttcatattattgcccttgtggctataaatatatttatgatttctagtgcagatacgaacttaaggttttagcaactttgtaaaatgttcatctaataaatccaatccttaagttgtttatctataaaatctagaacagatagtaatttatatcatcatataaaacttttataatgacagctattggcactactaaaaccatcccaacaaatccgccaaatttgtctcctataagtaataaaattattataacaaatggatgcatctctgtgctatcccctgttattttcggagataaaatatcgccctcaagctgttgaattatgaacatacccacaattacccaaaatgcctttattggagaatctaaaagtgcaactattaccgccggaactgcaccaaaaattggtccaaaataaggtattatgtttaaaattgcattcaatatagaaatccataaaggaaattttactttcaataataataacaatatcaatgttaatccgcctatcaatcccgaaagcatcaattgacttgttatatatcttgttaatactctatcaatatcgcttaatatttttttagtaagccctcttttagaagttggcaatagcaacagcattttactatatattttattaccatcgcaaagaaagtaataaaccataataggtattattgctagtgacattgcattatctccaatgctcattaaattttccactgcattttctgaaaaatttgtccaaaaaacatttcctttttctaaaatttcattataaattacattagtggtagaaaagtcatccaagttatttttctttaacattccttcaagtaagttgcttacgttatcaaatatattactgatattagatatctcattaaatagtgtaggaactataacaattatacatgcagttatgatacctataattattaatataacaactattgaggatatttttttacttattctaaatttcgcctcaaatccatccctaataggagtcaaagtataagctaaaataaaagatgctacaataatatttattattgaatttattgatttgttaaaaatgtaagctaatattaagcaaataaagcataatagggttatacctagaagaattgcttttttatgctttcttaattgcattgtgcctatccatattatgaggtaaagttttaaacataactccctcatttcctgtatataatatatattcctctccgaggatgcatctatttaatagaataatttgcttaccctttatcattttatctactaaccctgagcttataactattgctttaattgaataatcttgtatatctattataatatcctctagaactcctttaacattccccaatgtatcaataacttccatatacttaatctctttaaatgtaagtccctcacctttttttatattttctattattacatcttcacctatatctataacatcttccatgtctatatagttatttttagagaacagatggctattggataccttaaatcctacaatctttccccaaaagaaatctatgtataagtcttctataatgccaatctttttgcctttaatgttataaactttcttgaaatagaagtctctagttttaaacattgtgcacctccaaaataatttttaatagaaagtccttatgcctgcttatgtctatacactatatactgtagtgttcccctgtattctctaaaataagtaatatagttaataaactaaatctagttcatttgatatggtctccaacaagaggaaaattattcatattaatatactcaaatgtataattttaccgcacaataattttacacttaaaaaatcgtagacgaatatggttaattacgaaggctttgcctctatgggcgcgctcctacgaaaataccaatactttcatcatcatacattgtggatactttgtcttcatgagcagtactagagaataaaaatagtacctactatttagtaagtacttaatttcatcaactaaaatttttgagacaaaattttaatatccttagaatttaggtgaatctattcaataatatacaaccgttttctttaactttaataaaagagacactaccattatcagttattggaaaaattaatgtaagtataaaatgttcattctaaatgccaatttaaaaatgcagctttttattcgcttcatgacattcctctcttattatttagatctactcaatcacttccacttatatcttacttctaagtattcaccacctctgtcgtatcctaatatgttatatccatttttgttatatccttctttatcaaaacctgcactattaaatccatttctatcatatccttttttgtcgtatccttctctatcatacccttcctcattataatatgtcccatttctatgcattcctcttttaccaaatccatactcatcatacttcgtgccatttttatgaaatcctttagaattaaagccatgttcatcgtatctttttaacgccttgaagatattcaaaaaatcaccttccaattttttacttccaaaaatattatatcaagtatatcttcataagttaatactattatgtaaaatataggcaaatattttatcttctctagttggtagttcatattcacttccagtgtttatttatcctgactttttagtattatttctatcaattattaaatcaggataattactcacaaagttctttttaattctaaatcacatagttaatcctctcgtaaaacgcgcagcttgctctgaacctataaagctttttactgtctataacactcctctgctacttgcacattgaaatattctgcaacctcaaaaaaaaaaaaaaacgagagcacttacgcactctcagttttaaaaatatttaaattacaataactctttagattatactttctattattccgccgccaactactatttcatcatcgtaaaatacaactgactgacctttagttattgccctttgcttttccttaaagataactttcaccctaccatttggaagtggtattaaagtcgcttctgctggtcttgcagaatatctgattttcgctgtaacttctatttctttttctagtttatcaaaaggaataaaattcacatcagttgcaattaattctgttttgaagatatcatcttcagaacctagtacaacttcgttggttttagcatttatatttgttacaaatactggccttccaagtgaaagtccaagtccttttctttgtccaatagtataatatacaattcctttatgcttacctagtatattaccactcttatcgacaaagttacctggtttaaccctatttggttctgcttctgaaatatatttcccatgattattatcagaaatgaaacatatttcttcactatcctttttattatgaacagcaagaccaatttctttcgctatttctcttatttttgtcttttcataatctccacaaggcattaatgtatgttctaactgatcttgagtaaaattatataaagcatacgtttgatcttttctatcatcatcagatctgattaaaagatatctatcatctcgcttttcaattttagcataatgaccagtagcaacataatctgcccctatacctcttgctcttcttaaaagttcatcaaactttaaatgtttattacattcaatacaagggtttggagtttttccgtctatgtattcttgaacaaatttatcaataactttttccttaaaataatctctaaaattcaaaacataaaatggtatatcaagtttgtcgcatactcttcttgcatcatcaacagcagaaagggagcagcagcccccttccctttcttcaaattcctcatcgtgctgccaaatctgcattgtagcaccaatgacgtcatatccctgctgttttaataaatacgcagcaacagaactatctacaccaccactcatacctactaaaacttttttcttcataaattcacctattactcttctccatgtacagcagcatgtagatcttcatcactatgttcttccataggtattacttctaatccattttttgctctgtaatcatttatagctttatgaattgcttcttctgcaagaaccgaacaatgcatttttactggtggaagaccatctaaagcttctgcaactgctttgttagttaattcccaagcttcatctaatgttttccctttaattaattctgtagccattgatgatgaagcaatagctgatccacatccaaaagtcttaaatttaacatctttaatgatattatcttcaacttttaagtagattttcattatgtctccacacttagcgtttccaacttcacctacaccatttgcatctactatttctccaacgtttcttggattttggaaatgttccattactttttcactgtatatcatattaattttcccctttctttaaaaagtcatcccataatggtgacatatttcttaatctttcaataattggtggtacaacttcaagaacataatctacatcttcttctgttgaaccttctcccatactaagtcttaatgatccgtgagcaatttcatgaggaagcccgattgcaagtaatacatgtgatggatctaaagaacctgaagtacaagcactaccactcgatgcacaaacccctttaaaatctaatgataataaaatcgattcaccttcaataaatctaaaacatacattaacatttccaggaagtctcttatctcctcttggtccatttaatttagtgtatggaacttcaagtaaaccagctattaatttctctcttaacgcagttaatctttccatatgctcttctaaattattagtagcaagttcaagagctttaccaagtccaacgatagaagcaatattttctgtacctgctcttctattcttttcttgagctccaccgtgaattaaattatcaattttaattcccttctttatataaagaactccaataccttttggtccataaatcttatgacctgcaagtgataacatatctatattcatttctttaacatcaacaggaacatttccaacagcctgaactgcatctgtgtggaagaaaactttcttttctctacagatttctccaatttcttttataggctgaattgttcctatttcattattagcaaacataatacttactaaaattgtcttatcggttatagcatttcttaagtcatctaaatttatgaaaccttcttcatcaacatctaaatatgtaacatcaaaaccattcttctctaagtattcacaagtatgaagaactgcatggtgctcaatcttagttgttattatatggtttcctttattcttatgagctgatgcgataccttttatagcccagttatcagcctctgatccgccacctgtgaaatacacttcatcaggcaaacagtttagtgcttctgctatctgttctcttgccttatctatagctctttttgtttctcttgatattccataaaatgaagatgggttaccaaacttttcagtaaaataaggaagcatttcttctaatacttctggctttacataagttgtagctgaataatccatatatacgttcttcataatcattcactcctatccactatcttaatattattcttattgtttttaattgtctcataatcatcaagtatatcttgtaatgtaattgagttcataacatcgtctatgcttcttttaatcttttcccaaactgctttggttgcacagcaatccgagctatcgcactcaacaccatcaatacaatctgctatctcaactggcccttcaagaatagtcataatatcgccaactgttatgtcttttggcgctttacatagaacatatccaccttgagcacctcttatacttctaatcatattagcacgtctaagcgggctaaataactgttctaaatagtattccgaaagattttctctctttgatatagtttttattgaaactggggcaccaccataattagatgctaagtcaaccatagctctaactccatatcttcctttagttgaaagtttcattatttcttcaccccttttcgttttttgttgatatttctttgtttttctagtattataaaagatatattaaattcgcttatatcttaccaaaatactcggcttttgtcaaacgataattgctattatttttttatttctgcccagtatttcctcaaactctcttcatatttattattttgttcattataataaatctttccaagcagttcttgcggtaaataactctgttttacataatgattaggataatcatgaggatatttatagccaccaacaccaaggtttgctgctccagagtaatgagcatcctttaaatgcattggaacatctccaaaattcatgttttctagatcactcatagcagaatctatagctaagtatgcactattagatttaggaagcgttgctaaatatacaactatttctgaaagaattattcttgcctctggaagtccaacctttaacgaaagttctattcctgaattaacaacagataatgcattaggaaatgcaagaccaatgtcttctgctgcaataacagatattcttctaattatagcagttaaatttcctcctttaatcaatctagctagatagtgcactgctgcattaggatcgcttccccttatacttttttgaagagcacttaataaattataaaattcatctccactagaatcagcccgcatacttgattggcctagactttcaatatattcgctcgaaataactctaacctgcttaacctgagagtttacagccagctctaaaatattataagcttttctataatcaccttgagagatttcccctatatactccagcgcctcatctgaatattctatttctatcccttcatctataagcttttgtatagatctcttaagaccaactattatgtcacctgtagttaaaggtttaaaagagaatatattacatctgcttattattgctttgtgtataacaaaatagggattttcagttgtacttgcaatcaaagttattcttccatcttctataaactctaacaatgcctgctgctgctttttgttaaaatgctgaagctcatctatatataaaacaactccattataatttaataagctatctatattattagttatgtcctgaatatccttaaccgatgcaactgttgcatttaatttataaaatttcttatctacataattagccattatattagccaaagttgtttttcccgttcctggtggtccgtaaaatatgcaattacatatgttttttccagctatcaagttatataatggctttccttgccctaatatatgctgctgacctacaaaatcttctaatttattaggtctcattaaatctgctaatggtctcacctttcccactcctttctgcaattatcgttttaaaacgcaatcaaaaataataacaaatctcactttaatcattttctatcagagtaaaatctcaggcgactactgagtaggatgtttttttataaatctgactttttaatcctttggataaaaatctgaaagactaatttgacattctatttagcaacagatatatccttagtgccgctcttactgctatattacttatgtctaacccaaaacaaaatcttcttggtagttttggacttctctttttctttaatgcctcttaacttatatatgttgaaattcacaatgcacacttcacaattacgtctaaaattctcacaatatctttagaattatgacgaagatttatttttgcaatgtatataataaactttattttatataaagtaacactttccccaatatttctcttcgctagaaataaaaatagcgacaagtaatattatagcagatataaaaaaataagaaagcagtaagaattcaaaattcttaccgctttgcttctgctcttaatcaataattgttattatcatattttattataaaactcttagtttaatacaaatataattaataattccaaatctttatattcatctataaattcagctattaagctcggaatggtgtagattctgaacttacataatataattgtccagttttagggtttaataaagaaataactgctgttactgtatattcagctaatccagtttgtgttattcctaaatcagttccatcatttgtacttatatctttcttaacaagacaagtatctgaattcattgttatagtttaatctgtcagccagcctttctcgtgagcggaattgtataaaatagttgtaaattcaaaatttcatatactaagtatataccttaataagaaaaaatattcaatctttatttaaaactataatagtgcagttttgcttgaataattttacagttgaataaaaaaacagattattaagctatttttaattactcaaaaattttttctatcggcgtaccgcttgcggcagctttgtaaatatatattactttggaattctctaaattttttttagcaactttatatccagtattaaagtaaagaaaatcagtacagtatattttgcaataagtataatttactaacattatgattagatatatattaatgcttttcccacttcttacttgatatccatctagtcctaagtacgttttgcaatctctaaaaaatggttcgattgcccatcggtcagtatattgagttaaaatatctaactgtgctaatgatttttctaaagaaataaaagttttcaatgctccatctttttggaaatcatctttaggataacttaaaacagcagaaacaatctttctatcttttaagttgccaacataattgtaaatgtagtattccttatctttgacggtgacgaggtcaaagtcttcaatctttaataatgtagcaaacttatgaagttttatcctagtctttcatggccatacggaaaaataaccttattagtttttaaagcaccaatatagctatagccggctttttcagaaacattaaaaatatccttacaactatctgctaacacatagtctttattttcaggctttggaagtgttgtaattaatttttgagttatctttatcatagatatcaattgagtatggcagcactaatccgtcacacaatagtaaagaaactaccatttgatgaccatatacattcttaccttttaaatgagaattatgaaacgaatacttttcaattggatttttagcctttgacgatggctttatcttttcagaaatagtgtcataaatgataaagtatattggctgtttggattctcttgatttagcccaaataagttctatgatatatgcttttaatgctctttctaaaagtttttcattccaattactatttgaaaaaaatctagtaatactagttcgatgtttcgaatgagcaagctccgctatgtcagaaattttacagttataaacttttgatatcatagcattcattatattttctagatgttttaattgaggcttagttaagtaaaaatcaaaatttagttgttttaaaaaattgtatattgatagctcatctgatataattgtgttctgaaacatttatgtatagctccttgctgtcattgttgtgtggtaactcaattataacaaggatttatcatagatgtttttttattttatttagttttaaaattattcaagtatttttgcactattatagtcaaaactatttcttttataaatcttataataacaaaagtaaaataatcccaatccaatcatcgctcccataaaatcaactagaatatcactaactaatgaagtccttcctggtataaaagattgatgaaattcatcagttacagcataaaataaacaaataaacaatatgtaaattatcataccttttccgtttttattatacgcaaagaatacactgcttactagaattgctagtaccatatacataaatgcatgagcattttttcttactatatgatctaaattacttgcttcttcctgctgaacattaatgctattcttatttacttgggaactatcactactgcttactgccttatctttattttcagcttgtgatttttcttgatttctttgagcattttcaattatattaaccaccttagtgctttgttcatgagaaattgttccgttatttcctgacatataaaatataaatcccatccagaacaaacataaaagtataacgatttttttcaagtgaccacctctttttaattagaccatttgtgaattctattccaatagtgttaatagttatcttatattataccccatatatcacttgcttaaagcaaaagctgcactaaacataatttaatgcagtaattttatataattataattttcaatctcgccatttaacttataataaaatctattcttctgaaagacgttgtatcaagttaaaaattgcttctgcactgttaaaattttcaggaattatttcaattgcaggaacttcaatatcatattcatcatcaattacattaacaatttcaacaatatcaaacgaatccaaaataccttcatcaactaaagttgtacatgtaccaaaatcaacatcatctctaaccccttgtaataattcaattaacttctccataatatatctctcctttattgtatgattttacatattatataaacatatttgtaaatttactaaaactttaagttcatatcttcactagaaattataaatatatttgtgtagaaaacatttgaaaatgagttgttaaaggttcttagcggtaggttgttccattttagcttgtgaagtgagagtccaaaattttattttgggttctcgaacttcctcagcgaatgtaatgagtcgagcttccctaggaaagttggagcatgctaaagtggatgcaacctgttgcttagaaccttcagcgatattttcatagtttttcggaatcaaaatatttataatttcggtaagttacaacataaatctaaatttaatgttgtttatttattttatatattcttctattagcttcttgcgatcaatttttccattcatattgagtggcatgctgcttctgttatagcagacattaggcaacatataacgaggcaactttttcttcaaattctgtgataattttttagtctcaaggcttcctgaatatacagcaacaatttgatcactttctttattatataggcagcaacacatatccacaccttctaaggcgctcattgcattttctatttcacctaactctattctatttcccatatgtttaatttgaaagtctttacgcgaaacatatactaattctctattctcattccagtaaactaaatctcctgtacaataaacagtttcaggatagctcttatttagtgggttttgaataaatgcttctcttgttttttctggattattataatatccacaagccaagaaagatccacgaattaacaattctccaacttttccacattcttcaataagttgtccatcttcatccacaaccagagcatctacattatcgcatgtaacccctatcgggataggttcatcatcattaaattctctgtcaactatataatatattcctatatccgtaatctctgtaggtccaaacaaatttgcatatactgcatcaggaacatgtcttcgccatatattaagctgtttagtaggcattgtctctcctgcaaataaaatcttctttaaatcaggcagcttaatgacatctaaagctcctaagttagctactatacttaatgcagatggaacccaataaattgtgttaacttctttttctttcaaaaattcaagtagctttactggaaacgaaaataacattttaggaataatatataatgttgctccacttctaatggttgcaaatatatctaatacagacatactgaaataaaatggtgtctgatttccaaaagtagtattttcatttaactcaaaagttttaactacccagtctgcataatcaattacagatctatggcatacaataacaccttttggaattcctgttgatccgcttgtaaaaagaacatataaaggatcagtatcaatcatttgtcttcttgcagtcactaatttttcttcattttttggtaacatatgaatttcatcatacaatacctttatgcaatctgtttctataagcgaaagatatttttctgttttatcgtcgtaaattatagcagctggcttcaatgtatctaatattatgttaatacgctctacaggcatttgagcatccagtggaacataaaaacatcctgcatatgctgcacccataaatgctgaaatatttcgtgagcctttttccatatagacaacaacagctttacgcatacctatgttttctatcaaaaagctcccaatacttttagcttcttcaactaattcatgataagttaattcatatttaccatcagaaaaagcaactttatttggaaacttattttctgatctttcaagataagataaaatgcttttttccataatatttcctccataatctattttttcatagcttactttacattatcttttatataactcttatttggagacatcttcatcataatgacgaatagcttcattattattagatccttttgccctagcatttactcgtattttaaacttcttataagactttgaatcaaaatcaaaatctggatttttatcataatctcgtataatatgctcctgtccggtttctgaatctaataatacaaattgatattctggtataactttagacccatgcagagaatcagcttttaatgttatagtactatcactctttttccaattgaaccaagcagatgaaacataatctattgatgcataatattcatattgtgtataaaaatattttctcatatcatcaccattttggcgcttctttaggaaagctgccagagacttagaaaaagcttctgctcccttagtattcaaatgctctgtatcacaaagataatcatttttaagcttaaacaattctggctttattaagttataattgtaatattcaatatttaggttctttgctatctccgccaccttattatcaaattcaaagtaattttttactctgagaatttgaaatgtaggaaatggagttgttaaaagaattaactcacaattattttccttgcataattgagatatcttctctaaatattccatatcttttgagtttatatcacctatatttttattagaaggaggtaattttagattatcgtaatttagagttcctttttgatcactaggatcaaccttattgaatcctttccctacatagccactcttattgttttccatagcttctacttgtcctggttttggataatctgtataaaaagaatcaaattttccataaatattgtttactacatcaagaggtgatttcacatcatatccgcgccacggaaatagcctgtctaaataagaaccatcttgagacgatgcaaaataatattcaagcttatttaaaaatgatttcatatataaagaaactgaaagaaatactattggcttttcttccttgctagtaaaattatctggatcaaccgtcaaaacaattagtttaggtttatggtaagaaaacagttctttcaatgaatagtaagtccccacaaacatttgctgagaaaatgcataattgaaagtattttctcccaattccttatccataatatatggattaatgtctctttgagatagtgaggcacctgcaaatactacatcaaaatcttttttctcagaatacatttcacgcatggtcattcgtgaataatttccttttggcacaaggacaaatgctaagccataacttaaaataataaagaccattataaatataattccactaaaccatttatatttaaaattgcgcatacataaatcctcctaggagatttccggaactagcatcaaaacttatgacagcaaaaattaatgcataaaatactgcccatctaaaaactaaattttgcttagataaaaattcacgtatttttactcctctttcttgcaatacacttactgcaaataaaataaccgttgcccaaaataaaattctaaaatcctgttctttaagcccaagtttataaattgtaccatcaagtaattgagtaattttaaaatttgctacagtattatgtaacatataaagtgaagaattcagattacttgctctatcaaaataccatcctaaatttacaataaaaaatgttcttaatatcctaaataaatgatatgagaagcattcagtatttactttagttactctttttaaccattcataaaacggctctgcaatcgtgctaaatgcaatcacaattccgttatataatccccacgctacgtaatgccaataagctccatgccaaataccaacaactaaaaataccactaagttagaaaaggcaactggaataattcttcctgcttttcttccaatatatttatttgctagctttgatactttagacattttttttgaaagagctagaggataaaatatataatcacgcatccaagcacctaaagaaatatgccatctgcgccagaattctgatagtgaggttgaaaaatacggtcttctaaaattcacagccatatttattcctagtaattcagagatacccatagccacatcaattccacctgaaaaatctgcatattgctgtaatgaatagaataaaactcctactactgtaattgcaccaccataattatcatagttcttaaatgtttcattaactaatgtgattgctctatctgcaattaccatcttcttaaaaagcccccataagatcaattggagcgcatatttaaatttctgccaatcaaacctgtgagttttatatagttgttctgataatttatcaaatctattaatagggccttgtacaatttgaggaaaaaatgaaataaacagtgcaaatttaaataagtttttttctgctttatattttccattatatacatcaattaggtaccccatggactgaaaagtataaaaagatattcctaatggcaacagtaaatccaacttcattggaactgttccatgatgcgttaccatgttaaacaatccaacaatgttttttgatagaaaatcaaaatattttaaaaacgctaaaatcccgaaattacttaataaaacacaccagaaaattattctctgcttcttctttgcaaaagcctttatttgtttcttcccttctgatgttagtgtttcttttttttcagttaattcaattttcatattttcactaattttacttatcacaatcgttccaacccagactgtaaaagtcgtaaaaattatatatccaacaatctttacacccgcagatatataaaaaatgtaacttccaataagtaagcatatccattgaaccttcttaggcaaaatatagtatgccaaaatcaatataaataaaaaaatacaaaaattaaattgcaaaaacgacattgttccacatccttataaagagcttaatatacatgttttaaaaagtctaattcataaaaatttatcttaaactatatattgtaatttacaatgcacaattatggccaaaattattgcaatatttttagaattatgatgaaaaatcattttttcaataatatagttttataaagaatgaattatactatttaaagcttatatatggcaaaaaatatttaatatccaaatattttttattatagcactttatagaacttatgccatataccaaataagaaatataagaaatttttaatacttttgtactacagatatccagatttaaaattatatttatgtatggaaaaaccgaaattagatacaaattttttctaaaaagctatgaaaatattcttatctataatccacatattattccacaaaaaatacgttgtatcgacggtaagtggtattcccgcctgtacaacgcatcgatatttcatatgtatattgaaaatatttttatttatgtaatatcctgatctaaatttcagtgtgaaactatatattaatttcggattattttttaatccatatttaattctggcttccatatggttacttgattctttccatttcgttttgattttaatgatgctttatctgcattttttattaacatttccttatcataattgacatcaactaaagagctaattcctacactaatagtaatattaaaagtgttagatatagacttagatttgcttagtccaactttttcagaaatccacttcttaaagatattagaattaaataatttttccgatttgaacatgctttcttttatcacttctacatctaatgctgtttcttctgtttcttcttctttatcaccaatttcaaatttataatcactaataatattctttatttgctccataatagcccctgcatcttcactattagtataaggcaaaattatcgtgaattcatctccaccatatctaaatatgacatcttcatcacgcaaaatgcttctcataacttctacaaccttttttaaaagaagatcccctactggatgtccataagtatcattatattttttaaaattatctatatcaatcattgccatagatagatcattctcatccttttgaacttttataatatattcatcaagcatatcttgaaaataacgatgattatagactcctgtaagtccatctcttgtagctaatctttctacatttttgtataaaaaggcattttctagtgcacttgtcaaaggtgttatggttccatttataagttcaatttcttctattgtcaatttattttttgtgtttatatgtaaaatacccatacaactttcttttgataatagtggaatagaatatatgtatactttatctgtttttatttcagccatatgtttctttttaaaagcttcttccacagttccactaaactccaaaccttttttatcatccccataagatgaaataacattaatcttattttcatctactttatcaaatatacctaaagtacatgaatgaacttctataatctcagttactatcttaatacccatattagatacctcttccaaattcatagatgaggttattcttttagttagctcaaacagtctttgattattttgattttctttttgaagcttagcagttaatttggcattatttatagcaagtccaatttctccagatatagtattaatcaatttaaaatctgattctccaaaatctgaatcttttttacttcctaaaactaatacacccaatattttttcatgcatttttataggaattgtaatctgacctcttgtatcacttatgcaccgtatatatctaaaatccttttgaacatcatccgtgagtaacccctgtcctttataaaatttccatccaacaagaccttcacctattctgaaagttgtcttttctaactcttcatataaaacattagaatgtgatttcagtttaagttcatctttttctaacaaaaatattaatccaaagtctgcatttgtgtgagttacaagacgaactaatatagtatctaataactcttggatagatgccatattatatatagcaaatgctgtatcatataaaatactattttcaaattttaatattcttatacttctatttattttatctatttcattgaatagagattctccatctattaatttaacatcattagaatatttcctatctccaatatttaaattacttttcatttgttttaattttatatatactcttataattttatttacaataatggctaataataaaataatagtaaacatgaaataaataaaattgctaatttcccatttttcaaaggatataattattttttgctgcactaaaataataaataatgtaggcattaatatagcaatagtactaaagattagatacagtttaaatgtaaagcttttactcactattaaatctcccttttcgatataatatatgtttcaattcacaatgcacagttttcaatctacaattcacattttcaatttacagttaacaagccacagttcataattttcaatgcatagttcacaattactgccagaattcttgcagtacatattcaatttaataaatattaatcaaatttttatctttcacttttaactatttctgattgcatacttcataaactttggctaagtaaacacatccacaactccatatatttaaaatcaatgcttctcataaataattatcccctctttctctagatccaaagagaataactttattaatactttcgtacttatagtatatgcgcaatatatcatcaacaattttctgttctaaattcaaacttatctctcctttagcttgtcacacttaacatacataatattataacctataaattatttacttaaaacaataaatgtactaagtactcttttatggctgtcactattaacttctgccataatatattttatataaattttcattcatctatctcaaaccctcatgtttcctataaatatttacatatttaaatattttcctaggtaaatatttttctataaacatacttacctagaaaaatatattcccatgaacctattttcctagaaacatttaaacctatttttattctaaaatatgaacctagaaacctatgaatatataaaaaaatttaaattttttcatattaaagtatttatatattttaatatttgcatatatcttatatgagggggtaattaattctgcatatgacaaggcttatataatatattatttcttcatactttaatacatagggaggaattataaatgaacatgtctgtaaaaaaatctaaggtaaaaggcgaaatcaaggatgatttttccattgtagaaaatgaatcttcagatatatttaccttctcagaaggagagcttaaattagatgggactcttataaaatcattttcttttgattctgatgaagaacttattgaacatcctgcgccacccaccattcacgataccaccaccaacaacaacaacaatagcaataataattacagtaacaatgatagcactaatactacacctaatttaaattctcatgatattccatataatcctgatgtcaaaaatgaaattttggaccacagaactttaaaagttaatccaaatggaagaaccccatctgttgatggcgaagcttttgatatggtaagaagttatactttaagacgctctactgtaagaatcttaagtaaaattaaagccattcatattgatgataatgtttatttaaataccattgttgatgaagctattctttactattatgaataccttaaaactcaaaacaattaagttaatcttcttctattttaatacctaatcaaattatttcttatatataatttgattaggtatgcgaattgcaactcctgtttgatcaaattgataatcagtaccttcaattggatctctgcctttaaccatattcatccctatagtataaagtgcttctgccattgcttttgggtcttgaaaaatagtccctaacattaatccttcgttaattaacttctgtgattctggcaatccctcaacaccaactactgcaatatttttttctttatctcctaaattatatccataggattgcagtgcctcaattgcacctaatgccatggagtcgtcatttgcaattatagcttcaattttaggtccagtttttaaaaatagcgactctacggcctcttttgcgagctctctactccaataagcaaatactctttcaagctcctgagtttctactcctgcttcactaagtgctaaaagagaatattttgttctatcagctgctactaaattatttctttcaccttctaaaagaacatattgcattattccatcatggttcttatcaatggaatctctatttgtgttccattcattagcaagaatctcgccctccataattccatcgctttttgcatctaaccctatatatagagatttattatatcttttaatctcacttagcagcggctccctattaaaaaatatcactggaatattatctttagcaatttgattagtaactctttttaccgttaattcatccctgttcttaactagatgcattattataagatcaacaccttctttaagtacattatcaagctgctcattttgcactgcttgatttgatttagcatcataaaacgtaaattctacttttcctggattttcttcttgaatatcttctaaatctttgcgaactaaagaaatataatcatcactaaaatttattaaaaatacagctactctaataggtcttttttcagcagcattaatactcgcaaatgtggctttttctttaaagctaaataacatatatgacattatcattagaaacattataatagatagcattttcttaaacatttttacttcctccaacagtagaaattttccacaatgttattatgtatatcgcgaaaatatttatgctaacctattatgggtattttacaattatttaatattaagtccaagtaaaatagagtggtgataaataccactctatcgaaactctaaattttcatttagcataatacttatacttgataatttttattttccataggagtgaggttaccccatcctattcaaatatatcctttaattcaaattttaattctggaaatactggacttacataaaggtctttatgatttaaaactttaggtgtcatgtatgctctatctactaatgaatattgtgtaattattccgttttgttcaactatattatattcaagcaccccaaacctctgatatatattggctttcataaagtaatcatggtttgagtattctggtgatacaacttcaaatattattttaggtgctgatacaaaactctcgccttttttatcagtatcctcacacattacaaatatatctggtaaaaatttatatacttcactttcatttttaaatataacttctatttactcagaatatattgtgcatttacttcctttaaaaaagttatatagggtcgatgatattcccataacaattctattatgagccattgatgtacttgagctaaataatatttgaccgttatagtattcggctttaccatcataattagcttgtattttatcaaattcatctaaagatataaatatattattttgcacttgcatcgaaatcatctcctgctcaagaaaatttccaaattatcctcttataaatattatatcctaaaaactactcacttaaaataaaaaattaattccaatattaaattcacttatttaactccactttaacttcgtattcatttaagatattattatcatcttcatattttatgcttgaatctggcttattattatatactcttataataagcgttgttgttcctggatctaaaacaatattatcattatcaacaagctttgctcttctcacctcaccaatatctgaatatgaggtcaccctaaatactttaatatacttttcatctaatctttttatattaacacttatattatctgatgacgcttttgcataataaattctcttattttttgcttcactaactatactattactgttataattctcatcagtatagagttccatttcactgccatctttatttagcaatcctattttgttgtaataagaatagtaaactgttactttacatgtatctgatattccacttccatcatttgctgtacatgtgattgttgtagttccttgtgatattccttttacctctccacttgaacttacccttgctacatctgtattactagatttccatgttacttttttattgtccgcattgcttggcaatactgtttcctttagctttaaagtatctccttgattaataactgcgcttgattcatttaacattactcctgttacgcttactgtgtttttattattaagacttttatctgattctttttcagaattaacctttaactctgatccaacattgtttactatagtatccgttgattcaactgagtttccttccgtttctgtagcatatatttctataggatttaatactgatactgatgctactaccagtaaacatgatattacttttattaatttaagcttttccatacatcattctcctaaccatttttatttaattataccatatttttctttcagcattttaaaatttttaatctcactatgttattaccgcgtataagtatactaaatttaataatcctacctaacatggatttttatattcattcagtttccattgctcaattattatcaaaatgataccatttatcatctatctttatacatcctgtctgcattataccttcctcattaaagtagtaccatttagaagatttctcatcataataccatccagttttcatagctccatcatgaatatgataaatttaactctaaaattatagttgtttattgcttcattttcgtttaatattgttgtcaatataggttaaccttcttagaatttttgtgttgcaacataacctaaaatattagaggtatctatgctatttctttataaaattttattaaagcaatctatggatttatatctatagaagtatttctcaaatttatacacaagtcaagttacctaaattataacagaatctgtttagcagactatagatttcacttcttttaaaagttacccatagatttaactcggctataatctctttcgaaaagtaaaactattttcattatactttacgaagattttgccttcataatcagttactaaagaataaaaaaatacatcgtcaaatagatactatctttttatgccatatctatttgacgatgtataatttgatttcttatttattattgttaaatatactttgctaagctttagccgcttaagtatcctatccaaacaatgtcctatcacttaaggcttctgctccattagctttctcaaagagtccaagaagtttattattatctaatttttctttttcttcccctttgacgtcaactaaaatcttgcctctatgcatcatgaaaagtctattgccattttcaagagcatgtttaagattatgggtaaccataagggttgttattccactatcttttactatatttcttgttatatccattattatttctgatgttttagggtctagtgccgctgtgtgctcatctagtaataataattttggtttagacattactgacataagcagagttaaagcttgtctctgtcctcctgataaaagctgtactttattataaagcttatcttcaagccccaaattaagttcttttaccatctctttgtaataatctatcctctttttatttatcccaaagctaagcccaaaggattttcccttattatctgcaagagcgatattttctaatattgtcatattaggtgctacacccattgatggattttgaaaaactctcccaatagactttgatcttgcgtattcaggtttattaataacttcatcaccatctaataatattgatcctgaatctgcctcaagggttccagatatcatatttaacaatgttgatttacctgctccatttgaacctattatacttatgaaatcaccttgcttaacatccaatgataatctatcaaaaaccctattttcatttattgtattttgattaaacactttggatagttgtttcacttttaacatctttagcactacctcctataacagattttcttttcttaaatttcaagacaccgctattagaacataatgctataactacaattatggctgtcattaattttaagtcattggcatttaatccaagttttaatactattgctattgccgccttgtatatgattgccccaagtattgataaggtagtcactttaataaaagataatctctcaaataatgatgttccgataattactgccgcaagccccattacaacagtaccagttcccattccaacatcactaaatccttgatattgtgcagttagtgccccagcaagtgcaactaatgcattacttatcataagacctaacactttaaccaaatctttatttactccaagagatgaaactacttgttcattatccccaacagctacaagcaaaaatcctgatttagtctttaaatataagtctaatagtattttaactacaataaccattatcaaaatcactactatagccggaattgatgacttaaataaattaggagtattaaataatggaacatttgcttttcccattattcttaagttaatagaatataatcctatcattactaatattccagccattaaatttgttattttaagcttaacatgcaaaaatgctgttattcctcctgctaatgctccacctaaggttgctattattatactaatccatggattaaccccatttaccaaaagagctgcggaaattgcagccccaagtgggaatgtagagtccactgataaatcaggaaaatctaaaattttataagttatatatactccgattgaaactaatgaaaatagcagcccttgttctaaaatatttattaaaacacccactactcaacgcctccagttacctttttacaatttgattctatatctgctggaagtgttatatttaatttcttaactacatcagtgtttatagtaaatgacatatcacttaatgtgcttatttcaacatctgatggcttctttccatctaaaacttctgctgctttatatccagcttcttttcctagcttgtaataatctattcctatagatgcaagtccgcctttagttactactgcttcttctgcacctattataggaacgtttttatctaaacaaagtttacctactaacgcatatcctgaagcaactgtgttatctgtaggtgtatataatacatctatttgacctaaagcacttgctaaattttgatttatctcattaacatttgtaacaccaatttcttttactgctaagccttgtttatctgccgctgctttaagctcatcaacttgagttaccgaatttgtttctgaagtgttataaattactcctactgtttttgcatttggaagtaatttttttaataattctatttgcttgtccacagggactttatctgatgtacctgtaacatttgttcccgagctcttccaatcctttgctacttctgctttaacaggatctgttactgctgtaaatattattggaatatctttagttgaattataagctgcttgaactgctggtgttgcaattgcaaaaatcaagtctttctttgcatctgtaaattgcttagcaattgtttgcgcattagcttgttcaccttgagcattttgctgttcaattttaatattcttaccttcttcatatcccttttcttttaatccatcaacaaatcccttgttagacgcatctaacgcatcatgttgaactaactgaattactccaatattcttcactgccgatgatgaagcgcctccattattagaatccgttgcactttttccacatcctgcaagaattcctccaactaaaactgtacatagcagcatggctgctttcttttttcctaccatatttctatcctcctactatattcttattatcaatttcctactatactccaaaatgccaactaccttctcaataaatacaatcataaatatatatctatatttatgataattattcaaataaattgataataatttataaatcttttaagttatgatatcatattttgaaatacttgtaaagttactagctatgctttgcaagcttttttagttttttattgtaaaaattataattatgtctttttcatccttaacagcaatatcctttactataaattataaatattttatcactacaaaaattgcaatatacatatatattcatagtgtatttgaaaataaaacataaaaaaggcccttagcatgaaggcttttctattttagtttatcacactgataacgcgacttgttaaaacgaatacaacctcgtagcttagaaccttccttatttatatattcaaatatctactatactaaaagaacaatagacgaaataatagaattcttatccttccttattactttcatcatcatatgaatataaatcagttcacgatatactattcacaatgaattaagatttcaatatatatatttagaaaagccgacggcttttcccccttaattgtgtattgtgaactgataattgtgaattgttaaattggtaatgacctatgccctattcctatagctacttcatctaagtgcagaagtccaatacttaagaatatgcatactgaaatatgttctccacctctagctattccgatctttccacctatattttggccatttgctctatttgcaacttgaataaccgcatctctagttgcacctataacagcaccttcatgcaaatgctcttctcttattaattcgtttctttttgcagcaactaatgcactttcaagtattttagctatcgatgaattaatatttccgcctacatttactgctgtaactttaattcctttctctgcatatactttctttaaatgctcttcttcatgtctatcacatatagccattttagtagctatctttgcaactcttgtactattactttccataacttgatacctccaacgtattctctaggcacattataacacattaacttttcttatacctcaaaataatctgataatttatagataaacaaaaaataggactaaagagtatttctctactctttagcccctatattatacctaattaataatctctaatcttgttatatcatctttttagatgtggcttctttaaaaaatataattaataaaagtttcccatatctctgaatttattatatctattatctattagttcatttaaatctttttcttttaattctaacaagctatctacaattgttttcttaagaacctctgctgttttaacaggatttttgtgtgctccgcctctaggttcttttacgataccgtcaattatgtcaaaaccctttaaatctttagcagtaattttcgcaactgctgctgcttctttaactctgcttggatctttccatagaatcgaagcaaatccttctggtgaaagaactgaatatatagaatgttctaacataaagattttatctgcaactgctaaagctaaagctcctccactttcgccctcacctgttataattgaaattattggtgtctttaatctacttaattcaaaaagattatttgctatagcctgcccttgacctctttcttctgctcccatacccggaaatgctcccatagtatctataaaacaaattattggccttttaaatttttcggcctgcttcataagtcttaatgcttttctatatccttccggattaggcattccaaaatttctttttatatactcactagtatttgatcctttagttattgctataactgtaacatttatatcattaatagatgcgattccaccaattatagcttgatcatcaccaaagtttctatctccatgaaattcaatgaaatctttaaatatagtttctatataatattgcccagatggtctgtctttgtgccttgctatttcaacactttcccatggtgttacattaattttcataaaatctttatccataattaattcctcactccatgcaaaataagaattttatatatacatgccctcatattctttctttcaacaatggcatcaacaaaacctttttcaagtaaaaattctgctttttgaaaattatctggaagagtttctttaattgtgttctcaataactcttcttcctgcaaagcctattaatgcattaggctcacttaaaatgatatcaccttccattgcaaaacttgcagttactcctccagttgttggatctgttaatatagaaatatataaaagaccagcttcactatgctttgctagagctgcacttatctttgccatttgcataagtgaaaaaataccttcctgcattctagcaccaccagatgctgtgaaaatcattaatggaagcttattttctgtagcatgttctataagtcttgtaatcttttcaccaactacagttcccatacttcccatcataaagaagctatccataatagcacatgctacttctatgccatttagctttccaactccagtaacaacagcttctgtactatcagtcttagtgcttttcaatttttcttcatagcctttaaaatctaatggattagtagtttttaagtctttccagaattccttaaaagtatctttatcaaaaaatacttttattctttcttttgcattaagtctaaaatgatgaccacaagtcgcacaaacgaacttagaattttctaagtcttctgcatatatcattgaattacacttatcacatttttcccacatacctgatggtatattaggcttttcttcagaaatactcttttttaacgttgaggatttaacagttgcatattgtctttttacaaataaatccttaagcattcttcttcaccatcttttctgctaaaaatgaagtatcataatctccttctaagaattctttagtatgaagtattgataattcaaaatcaatattagtttttaccccacctactgcaaattctgctaatgctctatccatttttacaatagcttcatttctattatcaccaaaagtaattaatttagctatcatagaatcataacaatgaggaattttatatccacagaatatagccgaatctactcttactcccatgcctcctgggacacaaagctcttctattgttcctggacatggtctgaaatcatgttctggatcttctgcattaactctacactctattgcatgacctttaatctttatatcatcttgagtataagctaatttttctcctgatgctatcttcaattgttcttttactaagtctatgcctgtaatcatttcagtaattggatgctctacttgtattctcgtattcatttccatgaagtagaaattattatctctatcaaacaagaattctatagttcctgcattcttataatctacagctaaagctgctttctttgcaatttcacccattttagctcttaattcttctgttaatacatttgatggtgcttcttctaaaaccttttggttctttctttgcattgagcattctctttcacataaatgtataacatggccatgttcatcggctaatatttgaaattcaatatgctttggcttttgaacaaatttttctatatataatgaatcatccccaaaacaagcttttgcttctgttttagcagttttaaagcccattaagaattcttcatcattatgtgcaactcttattcctttaccgccgccgcctgctgatgcttttatcattattgggtatccaataccttttgcaatttctaaagcatgggcttcatctcttatttcaccttcatatccaggtactactgggacaccagaagctttcataatttctcttgctttagccttgtttcccataagctcaattgtctcataatcaggacctataaatttaatattgcactgtctacacatctttgcgaatttaggattttctgataaaaatccaaaccctggatgtatagcgtcagctccagttaaaacacatgcacttagaatgtttgttatgtttaaataactatctttaggcattgcagaaccaatacatacagcttcatctgcaagttgagtatgaagtgcttctttatctatttctgaataaacagctactgtacttattcccatttctctacaagctctaattattctaactgcaatttctcctctgttggcaattagcactttctttaacatttttatcacctatcctactgcaacgcaaaaagtatttcagcttcacaaactgtttttccatctactgaggcaatcccttttccaatacctataggtcctttaatcttaataatttcacagtataaatctagcttatctccaggtacaacttttcctttaaatctaactttatttatacctgcaaatagtggagtcttacctttaaatctttccattgaaagaatagcaactgttcctgtttgagctaaagcttcaacttgaagtactcctggcataattggttcttctggataatgcccttgaaagaatgcttcatttgcagaaacatttttataccctcttacaaattgcttttcttctatttccatttcagttactctatctattaaaagcattgggtatctatgtggtataattttttttatttcatttatgttaagcattaattattccccttaaccttaaataatggctggccatattctaccatatctccgtcattagctaagcgttctactattactccattatattcgctttcgatttcattcataagcttcatagcttctataatgcaaataacctttcccttagaaactgtgccgccaacttctacgaaaggtgagctttctggtgatgctgaagagtaaaatgttccaaccataggagaagttataatacttacatccttatcgtctataactacttctttttcagcagcctttacttcttctttctccactatatgattttctgatctttctactgaactaagtgaactagcagcagtgttaacctgattgtttacagctggagtataatttcctgcgccattatcagctaatcctctagttaatgatttatccatctttatatgatcatttccactttgaagctcaaaaaaggctaaacttgaagagtcaaccaatttaacaagctctttaattttttcaaagtccataaaaatatcctcctcttatatatgttgcaattcacaattcataatttaattcacaatgcacaattcacagcttaatgcacaatgctcaattatcaattcacatttcaattcgcaatgctcaattcacaattatcaattatcatttcacaatgcataattgcatatgaaattcttgtaatatttttagaattattcttaggaattattttttgcaatttatatatatatcttattcaaaaatattatttatatattttatgccgtactaagtcacattcaaaagttaatatttcttattaactacatttaacttttctggcataaaatatatgtaacactttttattttaccaaatatatctttattatttccactttttcaaaagtaaagtggcattatgtccaccaaagcctaaagagttagtaagtgcatattctaaatcttgctttcttccaacgttaggcacataatctaaatctaattcttcatcttttgttttatatccgattgttggcgggataaatccttcttcaagagcctttgcacatattattgcttctatcgctcctgctgctcctaaaagatgacctgtcatagattttgttgaagatatcggaactttgtatgcatcttctccaaacgcctttttaatagctgctgtttcaaatttatcatttaattctgttgaagttccatgagcatttatataagaaacttgttctggtttaattcctgcctcttgcaacgcatcagtcatagctcttgaagctcctgctccttctggatctggagatgtgatatgatatgcatcacaagttgatccatatcctacaacttcagctatgatatttgcgcctctagcttcagcatgttctaaagattcaagaattacaactcctgcaccttctcccattacaaatccacctctttccttatcgaaaggaatagaagctctttctggattatttcctgaatttaatgccttcatactatggaatccagtaactccaagtctagttataggtgcttctgctccacctgcaagcattacatctgcataaccatgttttattgttctaaatgcatccccaatattgtttgttcctgttgcacaagcagttactgctgatgtacatggtcctcttaatccatatttaatagctacatttcctgcacctaaatttattattgtcataggaacgaaaaatggagatactctcttagactttccagttgcaattttagtacattcagtttcaatagtctcaaatccacctataccagatccaagcattacgccaaatctctctagattttctttttctaaatctattcctgaatcctttattgcttcatctgatgcaaccaaagcaaattgagcaaatctatctaatctctttgcttctttcttacctattaaagtatctggatcaaagcccttaacttctgctgctatttttacatctactaaatctttatcaactaaagttatataatctattcctagctttccgctttttgcattatcccaaaacgtacttacatcatttcctatcggagtcagagctcccatccccgtaattactactcttctttccataaatcaaacttcctccattacattaacattccaccgtcaacctggataacttgccctgtaacataatctgcactttcacttgcaaggaaagctacaacatttgctacatcacttgcttttcctaatctcttaagcggtatagtcttcttcatctcttctttgtatttatctgctagagcttctgtcatatctgtttcgatatatcctggtgctactgcatttacattgattcctcttgaaccaacttctctagctaatgattttgtcattccaattactcctgctttagacgcagaataatttacttgacctgcatttccagtaattccaactactgatgaaagatttattatctttccatgtttttgtttcatcataattggagtaatagcttttaagcagttaaacacaccttttagattaacatcaataacattatcaaaatcttcttctttcattctgattattaatgcatcttttgtgattcctgcattatttaccattatatctatagtgccaaatttttctttggcagaattgataagattatcaacttcttctgacttagatatatcaccttttacacataaagtttctacacccatgccttttatttcattttcaacttccaatgcttctttttcattacttctataatttaaaactatattagctccaagagatgcaagctttaaagctattgcctttccaattcctcttgatgctcctgtaacaattgcacattttccttttagcatatattaaattacctcctattgttataaacaattaacctataactaagctgcaaataattatttataatccatctactcattctaaataactattcctatattttacaataataagcctacatttaaaatcctagcagaccatgtgtcagttaagataaaaatgcagagacttacttttaataaatatatatttatatattaaagattgcttttaatcttatcaattgtatttttcaatgaatccatatcctcaacatttaaaagacttgcactcttatttattttcttaacaaatcctctaagtgcttttccaggacctacttctataaatgtatcaacgccgctatctatcatatgatttatagtcttttcaaaaaggactgatgttcttatatgtctctttaataattctttaacatcatcttctttttcataaggaagtcctttaacatttgaataaactactttgttaagttctttaatatcaacattttttatagtattaaagaattcttcacttgcaggctcaagaagggaactatgaaatggtccactaacctttagcgaaattccaaggcctcctaattcttttgcaatttttacggcttcatcgattgctttgttttctcctgaaataactacttggcctgggcagttatagttagccccttcaactattccaaattcacctgctctagttaataattcttgtatcttttcatcatttaattttaacacagcagccatttttccaaggccttctggtagcgcactacccattattcttcctctttcttttataagaagtaatccttcttctaaagaaagtgctcccccgtatattaacgctgcatattctcctaagctaaggcctgctgcataatctgcttcaatgccatttatctctagtgcttttaacgcgataagtgatgcaacaagtattgtaggttgtgcattttctgttgctgttaaaatttcttctggcccttcgaacatcattttcttaataggcatatttaaaatttcttcactacgatctaatatttctttacattctggtatattatcgcaaagttcttttgccattccaatagtttgaactccttgacctggaaaaagaaatgcagtcttactactattcatgattccctccaaaacgcttaaatatttcatttgattctgtaaataattcttcaatcatttccttacatgattgttccttgcaaataagtcctgctatttgacctgacataagtgatccattatccacatcaccatctacaacagcctttttaagcgcaccaattccaagcttttctaattcttcagcagatgctccttctttttctaacttaagataagttcttgcaagcttatttcttagaactctaactgggtgacctgttggtcttcctgttacttctgtatctatatcattggcttttagtactttatctttataattttgatgtattgtacattcttttgccactaagaatcttgttccaacttgaattccttcagcgcctagcataaatgatgcagctactcctctaccatcacctattcctccagctgctataactggtacgcttacagcatcaacaacttgtggtactaatgtcatagtagttaactgacctacatgcccacctgattcagtaccttctgcaataattgcatcagctcctgacttttccattcttttagctagtgctacagaagctactactggtataacctttattccatgagctttccatttttccatatactttcctggacttcctgcaccagttgtaacaacagatacgccttcttcacatactaattctgctatttcctcagcattttctgccattaacattatatttacaccaaatggtttatttgttaattcttttgttttctttatctgttctcttacccattcagttggtgctgccccagttattattccaagtccaccagcctcacttactgctgaagctaaagatgcatctgcaattctcgccatagcaccttgaaatataggatattctatttttaacaggtcacatactctatttttttccacaacatattcctcctaccattaccaatcacaaaatatcgcttaatgtactatctcttactataataatggaacttcctgtattttaatcttatctatgtataatagtcatttcacctatcatgataagtaattttactattatagcatatttttatcaatgagattactaaaaagttaaaaataagttcatattctccaacgtttatacattggtttttttataaatattaaattgcatcttgtattatttttaatctcaaatgatatgatatttatttccataaccattccattcttatatataaatctattttaaagttaaataataaaagcttatttaactattatttttaattaccactcaagtaatgttgctgcataagttaacccaccaccaaatgcgacaagaataattttatcacctttatttagtaagcctttttcatacatttcatttaaagctataggtactgttgcagctgatgtatttcctaccttttctaagttcaaatagaacttatcttcgcttaatttcaacttttctgctgctaattttataattctataatttgcttggtgaggtactatatatttaatatcgtcaaatgaaacattagtatctttcataacttcagtaacagcttcatctattgcagatactgcaaatctaagtatttctctaccattcatatcgatagttcttttagctaattttttctcttttgaaaaaggagtatcaaaatcagtagcgcctatagtaagtgcttcccccttctttccatccgctcttaaatatgatttaattattcctggtgcctcatccctcttaagtacagcagcaccagcaccatctccaaataaaatacaagtgcttctgtctgtccagtctgttacttttgaaagaacttcagctccaactactaatgcatttttataattcatagacatcattaaagctttagctgtctccaatccgtatacaaaccctgaacatgcaacacttatatcaaaacaagctgccttacttgcatctaaattactttgaactagacatgcaaccgatggtataaacatatctgggctaattgtagcaacaataataagttctaaatcttttgcatcaataccagctctttcaagggcaagcttagctgcttttgttgagatatcagatgtattttctccttctgagattcttctttctctcatacctgttctttgcactatccactcatcacttgtttcaacgaattcacttattctatcattagtaactactagagatggaagatatgctccaattccagcaattttaatattactcatatttttctccttcattatactaattcatatttttctttaaaaaagttatttattttacttaaagaagaaattaaaatttcttcctcttctaacgttaatccttctattgcattatttatcatttctccatgaaatctctgatggattctgaatgctaactttccttttctagttaatttaataaggacaactcttctgtctgtttctatcctgtttctttctacatatccttttttaattaatttattgatagcagttgttaaagtacttactgtaatttttaatttctgcgctacctctgacattgttctttcactgtacataccaatagattctatagtatgaatttctgttattgaaagatctgaaagtacaccattctttaaactttgctcctcaatttgtaagacatcattaaataactgcaccaaaagctcgttaatcagttttgttgatttatccatttatctgcactctccattttggcatccaaaaatatcttctaacaaaaattatattcagtgtttataaaatgaaaaatttggtaatgaaaattctaaatatcataccaaatacgcaatctattgaccaattagacatatgaaataaaataacaagcaaacgacataaagatattttgtcctaagatttgctgaggaaagttcattttgaattcagaatgaactacatgaaaagtttcactttactttagacaaaatatataaacaaacatatttactttatattttctgagtatgcctcgcctttaatcaaaaagttttaaaatcaaatagtttgataatcaaaatatactatactcaaaatacattgtcaaatttttttcaattttttccagtctcttgtatgcttttaattagcaatttcatatgatataattaattaaattagttaatattatctataatattaatttttaaacataggaggtgtacatatcatgactagaaagttaattatagctacagttttaatgttaagtaccgtaatggtttcttgtagcacaaagcctagtgattcccctaagcctagtgataataacactactactgtagagcaaaataaagacgacaatggctcttctaatgctgatagtaaaaaagctaatgaaactacaagcgatacaaaaaaagtaaataaggtaaaactttctatatatagtatagatgataactctttagaaccaaatgaatcaggtactattgaggtaaatgaaaattcagctctacaggacaagctaaaagaattagcaaaagctgtatcagagaaaaaatttgacaatttaccaattgaagttaaatctatagatactgttaacggcaaaaaagttgctactataaacttaactgactcaaataataaaaaatgggttccaaagtttcaaggatcaactggtggttcagttacagctaatactttgattgagaatttccttcaatctaataacaaatctaaaggcgaatggattgatggtgtaaaattcctatataataatgaaacaatagaatatgaacatgcatcagacttatctactgttaagtatgcaaattaattacattaagttataacaaaaagaagccaagctttaatatttaaaacttggcttcttttgctttttatcttattatccagtatttcaacaaaatctcttcttatataatggtatctatttcaaagttcttcaaatttttcttcattagaatatatatatgttgcaaaaataattcttcatcataattctaaaaatatcgaaagaatttcatatgtaattatgcattgcgaaatgataattgataattgtgcattaaattgagcattgtgcatttcaatatatatttcaatttattaagaaattactgtatatgtttgagtataagctatttgttcatcacctaatgtaaggtaataatatatcggtatcatatacgttgaataaaataatgttgaagcttctggcacattgctttctattgctcttactaagagttgttggtgctttaaacttacaatatagcaagtagctataattacaatttgttctgaaaaaaacacgtcagaaattgaatttgaatatttatcagcatgatttaccaaattagtcctaataattctaagttggtcaatataacgctgtatctcaacatcaaacttctttaagtcatcaactggcgtatctggttttatattatatacagttaaatttgcccgtataactttaatttgatttaagctattaataatatcctccttattctgtaaattagatattttagggccatactgctgaggtatattcggaatttgtgcatatgctaaattacttgtgaatactgttatgaatactacaaacgttatcaaacggattattattttacgcattattgttcctccatattataataaatctaccttatttacaaaaagtactctttaagtttatcctttgttattttaaatattttattcctaaaagatagattatattaatgaggatatacgcactactcaaagggcagccgttctattgtttccagtactgtatagataaccctactaagacctgaacttatgtatatagctcgccgaaataaggattatgctgttgttccagtttctaaggaattatgatggatgatcccaagattacaagttgcactcaagatgctagcatcaaagaacaagcgctcacagagaaagttcgaataacgaaatgtgaaattcccacagggaaagttttgcgaaccaaatataaaatttggagcatcacttttcgattctcactttttgaactagcatacttgaaacaacttataatctaggaatcagagccatcaaattcctaatgaaacatttcacaaaagcataattcttatttctagttgggatatatttaatagtataaatctaacttataattggtttatccatatggatatccaatttaagaattcagcttattagatgaatgtatttacaaatttactaaaactttaagttcatctcttcactagaaatcataaatatatttgtaaccacaagggtcataatatgaagaaaacatttgaaaatgagttgttaaaggttcttatatttttcaagtcctcttattggatccaattctttgtctttcttcatatactctaaaaagaattcatttaattctatacttttttctacatctcttaatgcttttaaattttcatttatatttacataatagcaagctctattataatatagaaaaccttcatcatcattttcttctattcccttacttattacttcaatagcttttttaaaattaccttcttctctatattctacagataaatttaaaaaactataaggataattgggattttcttcaatagacttgtaataatattctttgctctcttctatcttatttaacttatttaaaattactgctttattaaataatatcttgtaatgtctgtcatcaatttctagagccttatttatataattcagcgcatcaatattttcattattttcttctaaaatacaagctaaatttgcatatgcccacatataattaggatttatctcaataacctttttatagttacttatcgccttatccttttcacctgattcatcatatatattggctaaaaagaaatatgctttatcataattaggatttttttctatggccttctcataataatttttagccttttctaactcatcattttcatcatatattattgccaagccataatatgctctagcatcatcctcatctaattcaattacttctcgatactttttctctgcatcaccagataatccaatttcatcgtaaattaatgccatatccatcagcaattctatatcttcttttcctatatttaaggcatatgccttctgataaaatgaaatggcttttaataagttattttctgaccttaaatttctcgccatatttatataattattgtataaataatttttgttttccatcttgttcttcatccattcatttgatttgttaattctaatatttattatgctcaaatatactcttaaatttaatcctgataaaataattacttccttagaattatatcactaaaataataaaatactcaattgtatataaattgagtattttatcatattgaacttatatatattgcaatttgatttgcacatttaatcttatgctggtgctttatttattaaaattttaaatgtagcttcactattacaatatatactatttatttttatatacatctataacattttcggttttataatgaccgtagtaccaagtatttgtataagaagttgttttaaaattcaaagaatcagcaagcttagtttctactccatcctttgtcttccataaactaaatgaatctccatcttttcttacaaataatatttgattttctgataaatattttggcatgaaatcaaatgatttattatttgtaatttgagttatttcttttgtttcagtgttcacttgataaatatagtgtggttcactttcccagtttttcgaactttgtgacatatcatcttttaaggcatcagctccagaatatgctatactttttccatcactagaataatccggtgtcattgatacttgattttctggaattagacttgtaaatttgttagctttgatatcgaaaattcctaatgttttgttgctatacatatctctatattcgccattgttaacagcaactatgctgctatccactggattttgagaaatattatctttgtatgctaatgcaatcatattattattttctataaatttattgtttaaaagatcatatactgcaaattctgtcatatctgctgacattgagcctgaattaggtttgttccatacgtacatgtatctatcatcacttgatatcctctcaacattaggccttgatccaatagattcaaataactcagatgctgtatactgctctccaatctctttattatttccttctttaccttccaaaataaccttttcttctttagtatctaagtcatagctaattatacctattgatttaatagtttttccgttatctgtagtagtttctagctgtttattagcatatactttatttttactatcgcaattaatattaaaataattatattcattgcttataatatctactaactttttagtattggtattatacatagacataccttcatttttagcagagcaaattaaatttcctgagttattccaatcatatgactctacatttttagctacttcaattacttcacgagtctctatattgcaaatatataaatcatcttctttagtataagcaacatataatccatctttagatattttcggcaatttaattttttcatttttatcaagaagaattgggttatcttcttttagttcagacatgtatagcccatcatctgatacaaatactgcaaattctgctcctttagcactttttgctgtatcactattactagcaaatacagtttttgaagcaagcaaactagtagatgtaaaaatcatggttaccataagtgaaatacaaacaactattttttttgactttttaaaaaacactatatttttcaagcgtgtctcaatctccttcctacttttacaaactgatgcccctaagcttagggatttattctgagaatattctattaactctaatataatttctccataatattttctttttgatttatccatattctttataagttgttcatctaaagacaactcacaaattatatttatcctatttctaataatataaacaataggattaaaccaattgattatatttgctaaaagcgctactgccttcacccataaatctttacgtttaaaatgaattaattcatgatccagtattatttcaagcttgtccagattgtggttcatcttaggaattgtgatagtaggtgtcaatattcctgtaatcattggacttttaatgccaccacattcttttagaattatctttctatatatatttaattttttcttacagttttcaaaaacatcaattattgatttatcatcaataatatcacttacacttttaagttttttataaaaagaaatatatacgtaagtttccttaattactagtatgagtacacctaatatccatgcataaatcagcatatttctattcattattttttgcatcatacttgtctgctttaaatccgcttggctttggcttacaggcttaagagtaccatccccttgcaaaactcttatctcatcacttttatcattgctcttaagcatcttttcattattttgctgcgctactgtatttgtatcctgcattgataaataattcttatattccactatttgaggcagtttaacaaaactcccaataggtataataaaaatcaaaagcgttataaatagcatataataattccaagtagcactaaaagttttcttagtaaatggcccaaataaacaaagtattaaaaacataaaactgcctgctagtgacatttgcagaatataatttagaatattcatatgtctacacctctttgagccattctttcaactctgcaatatccttattgcttattttcttattattaaacaatgttgccataaagcttttaactgatcccttatgaatatcttctaagaaattatcagtttgaatagctttatattcttcttcagtaattttaggaaaataattatttaactttcctactttagttacactcaaaatccccttttcagttaatcttgatatcaacgtcattattgttgttaccttccatgaattttcttttggaagcgcgtctaaaatctcagctgtagtaatttgatcattctttttccatattattttcattatctccatttcagcgtccgatatcttccctaacttcatattcaatcatctcctctatataattctacaaggtgtagtattcatgtttttatactacatcttgtagaattgcatgtcaatatattcctatgaatttttaataaaaaacttattgcatatgcatgttacaattcacaatgcacatttcacaattacggctaaaattcttgcactatatatgttgcaatagaatttctccattttggttttaactaaacatttactttactagaattttaaatgtaaatttattatttcaacatatctattcaaaccaaactacacaaaataagctattaaaaacagttaatgcagggctagtctccttttgcttgttctaatgaattaagaacatgcgcgagaagatgtaaccctacattagtactttacaacgaatttttcataaatctgctaagtaaacatatatgttgcaattcacaatgcacatttcacaattacgcctagaattcttacaatatttttagaaattttatgaagaattatttttgcaatatatattgaattaatttatagcaatttttatttttctatttcactttccatttatatcttgtttctaaaaattcccctttcctatcatatccttttatgttatatcccatcttgttatatccttgcctgtcatatcctccactattatatccttctttatcatatccatatttatcgtacccgtctatattgtagccttctctattaaaatatgtgccatttttatgaaccccttttttatcaaaaccctcttcattaaattttgtaccgtttttatgaattccttttgaatcaaacccatgttcatcatatttctttaacatattaaaaaataacataaagattgcacctcaattttaatttattatctatatacttatttaagcggacgaaaaaagaccgaccttaataaaaaggtcggttgcactattaactcatcgaatataaagtgcccaagtaaatattcgaatcacagtttccttatatacataatattactatttaatgatcattttaacatggaattaattacaaatcaatgaacaaatagtgaataaaatgaaacaatttcaaattttaacatatacattgcaattcacagtgcacaattcacaattacggctaaaatttttagaattatgatgaagaattatttttgaaatatatataagctattaggtgttattgattaaataataataatacctaatagctcatttctttaatatatatttatttatgtgttcctatatcacttctacaatatgccccttcaaaggtaacatatttaatattttcgtaagcgtcttttctagcttcttctagagtttttccaagaccaataactgatagtactcttccaccgttagtctttaaaactccatcctctgccttagctcctgctaagaataccttatctttaactttttcatcaattgttatctcatatcccttaacaaaatctcctggatatcctttagatgctaaaacgacatttatgcagacaccatcattccacttaattgtagttttatctagttcttctcttaatgccgcttcgataacttctactaagtcactttccattagataaaggaccgattgtgtttcaggatctcccattcttacattatattctaaaagataagttccttttgcagtaatcatgataccaaagaagattattcctttataatcaaagccttcttctctaataccaattaaagtcttagccatgatattttcttcgaaatccttcatcacatcttctgtcacataaggatttggagctaatacacccattccacctgtgtttggtcctttacctccatcaaatatctgcttatggtctttacctgatatgaacggaattattgtcttcccatcagtgatagatagaattgaggcttcaacaccttctaggaattcttcaattactattttttgaccggctccattgaagatatcatctaccatataagattttactgcttctattgcttcttctttagtttcacatatagcaacgccttttcctgccgcaagaccatctgctttaaccactgttggataaggacatacttctaaatatttaagcgcttcattgacatctgtaaatgtttcgtattctgccgtcttaactccatactttttcataaattctttagaaaagcttttacttccttcaagcattgctccattttcagctggtccaaatatctttaatccttctgttttaaacttattaacaattccttttgttaaaggatcttctggcccaactattgtaaggtcaataatttcttctttagcaaatttaattaattcatcaatatcagttatgtttacattttcgcatttattttcaattgcagttccaccgttacctggagcaacaaatattttttcaaccttttcactttttgcaagtttccaagccaaagcatgttctctaccacctgaaccaattaaaagaagtttcatttacatacctccaaaataatattccgttatagataaacagtatacactcatagcctatgttataaccaaccgaaagaaaggatactctgttgtttcggttgtcttagagaatacaactgtggatttctaacattaaaagttgcgtccatttctgcatgctcccaatgcaagattggtacaagcaaaaatggaacaacttctaatgaagaaatcctacagccatattctcagatgcaacactgcacaaaagagtaccctttctttctaatgtgggagtcatttcaaagcataagtctaattcataacttgtttatctataacaattaactttaaaaaacacagggtttttattatatattttcaattcaatatagaatttattgcttaatcacctaatataaataacttatttatattaatgtttgaagtgtctatatcctgtaaataccattgagattccatatttgttacaaacgtctattgactcttgatctctaatagatccacctggttgaattattgctttaataccagcttttgctgctgtctctgcaacatctccaaatgggaaataagcatctgatgcaaggatagtagctccttttcctctctttaaagcgtcttctgttggccaaattctgttaacttgacctccgccaattccaagtgcaattccattgtgagcaacaactatagcatttgatttaacgtatttaactactttcattccaaataataaatctttcatttcttcatcagttggtttcttttcagttacaactttaatttcttctactaatttattatcttcctcttgaacaagcattgccccatcaactgtaaccatatatttatctgcctttggagtgttatggaatttaagaactcttaagttctttttagtctttaaaacttctaaagcatcttcatcatattctggtgcagctataacttctaagaaaattttaaccatttcctcagcagttttcttatctacttttctattaaatccaatgattcctccaaatattgaagttggatctacttcatatgctttcatataagcttcataagaatctttcccaattgcaacaccacaaggtgtattatgttttaatgcgcaacatgctggttcatcaaattcattagcgcatttccaagctatatcaacatctttaaagttattataagataattccttaccatttaatgtttcaaaagtattcatagctccatcaagcattgttgatgcgtaaacagctgcagtttgatgtgaattttcaccatatctaaggctttgcatcttcttatatgaaactgaaagatattctggatattcttcctcctcatcagctaacaagaagtttgaaatagccccatcataagcgctcataagattaaatactttaccagctaatttcttcttagtcttataagaagtttcgccatttgcttcaatctcttccataacaactttatagtcatttttatcagaaattactacaacatcctgaaaattcttagctgctgctctaagcattgtaggtccgccaatatctataaattcaaccttttcttcaaattctaaatcttctttaactttctcaaagaatggatatagatttacaactacataatctatagtatgaatatttcttccttttaatgtattcatatgttcttcattgtctcttatagctaatattccagcatgaactaatggatgaagtgttttaactcttccatctaacatttcaggaaaatcagtaacttcattgatttcaattacatttaatccattttccttcaaatatttataagttccacctgttgatacaatttcaacatctttagatactaaaaatttagcaaaatctaaaactccctctttatcaaatacgcttattaaagctctctttttcacgaaaaggcctcctttattcttctatcttgactctaccatcaattactctgattttattttcgctaattaacttaattgccttaggtaatatttcgtgttctttttctaaaatcctcttttgaagagtttccgcatcatcttcaaaataaactggcacaacttcttgaagaagtattgcaccaccatcaacttcagaatttacaaagtgaactgtacatcctgaaaatcttacaccacttttaattacggcttcatgaacctttaatccgtacattccaggtccacaaaaagatggaattaaagatggatgaatgtttataattctattatcaaattcttttaatatttccccatctaaaattgccaaaaatcctgcaagaactattaaatcaacctttcccgttgttaattctaagatcttgttagaggactcttcaccatattcacgcctattaacaacaaaagtatctatattatgcttttttgctctctctaaagcataaatattatcacggcttcctataaccatctctatcttaacattcatatagttactttcaaccgcatctattaccgattgtaggcctgttccgcccccagaaaccaagaccgctattttaaacaaataccttcacccccagatgttacgtatcctatttcataagctttttctcccatttctactaaagcctttataataggttccacatcttcatctttaacagcaagaacaaaccctattcccatgttaaaagtgttatacatatgctccttgtctacacctttttcaatgattctttcaaatatagctggaagtggatatgaatctttgttaattacagctgtgaagtccccaccattaaacattcttggaacattttctataaatccaccacctgtaacatgagccatacctttaatctcatagctttctaacaatttaagtactggtttcacataaatcttagttggtgtaattaatgtcttccatacttcttcgccattaaattcttcatttaaatctgggaatacttttcttattaatgaatatccattagaatgtattccagaagaagctataccaatcaacttatctccatctttaatattgcttccattaataatcttatctttatccgctataccaactgcaaatccagccatatcatattctccatctgaatagaatccaggcatttcagctgtttctccaccaattaaggcacagtcagaatcaacgcatccatccgatatacctttaactaaatctgctgcaacttcagcttcaagcttcccgcaagctatataatctaagaaaaataatggttttgccccatggcataaaatatcatttacgcacatagccacgcagtcaataccaactgtatcgtacttcttgttcttaaatgctatttcaagcttagttcccactccatcagttccagaaactaaaactggtttttcatagcctgatggtaattcaaccatcccagcaaaacttccaagaccatttaaaacatattgactcatagttcttgctgcatattcttttataagcttaactgatttatatccttcttctatgttaactcccgcttctttgtaagtaatcatttattaactccacctttcaaaatgctattgacatattcaaaaaacaatagatgaatgtgccttagatgtctatatctctttctctactggtgttgcaactgggtaaactccattaaagcatcccatacaaaattcttctctatcaccgcagctcttataaacgccttcttcacttagatatcctaaataatctgctccaatcatatctctaatctcttctatagtattattagcagcaacaagctcacttctataaggtgtatctattccaaaataacatggatatttaacacttggtgatgctagtaagaaactaacttcttttacacctacacgtctaagcgattcaactaaatgctttgacgtagtgcctcttactactgagtcatcaataagtataactctttttccttctaagtttgattttagtggatttaactttactgcaactgctctctctcttatttcttgagatggcgatataaaagttcttccaacgtatctgtttttaataaatccagtatcataaggtataccagaagcctttgcatatcctatagctgctggtattccagagtctggaactgctataacaacatctgcatctaatggatgctctttatataactgttctcctgctttaactcttgttgtatgaacttcaagcccatcaattctagagtctggtctagcaaaataaatatattcaaaagcacatgtctgacatttagtattttcagaatatctgtatgattgtattccttcactatctattataactatttctcctggttctatatcccttacaaattcagcacctattgcatctaaagcgcagctttctgaagttagaatgtaaccttcttcaattttccccaacgaaagtggtctaattccatgtggatctctagccccaattaatctatcctttgacataatagttaatgcaaatgaacctctaacagctgacatagcatcaactactgcttttgcaaaacctttttttgcacttcttgctataagacatgcaattacttcagaatctgttgtagtatggaagatttgtcctccatcttcaagcaattcttttattacatctgcatttactaaagttccgttatgagccatcgctattggtcccatctttgatgaaacaagtattggctgagcattttcaatgccttttccaccagcagttgaatatcttacatggcctatagctatatgaccctttagcttttgtaaatcttcctgcttaaatgcttcagttattaaacctaatcctttatgtatgtcaattttttcaccatctgctactgcaattccagcactttcctgccctctatgttgaagagcataaagtccatagtaagtcattgatgctacatctattggcttattagtatatactccaaataccccacactcatccttaaatttatcattacttggatccattattaattcaaaattcggattactcatctatacaatcctttcactaatctatttttgaaaaacttaaaatacatgagaactaatgcacaattaaggatgaaatttcttttgacttctaaatcacataattcatcaaacttcatcagagaaatgagaattcaaaataacactcaagacttaatgtacgaattctcaaccttcctctgtgaacttagttccctcattgtgcattactaattgcattttaatataaattttatagtaaatctgattctaaatatactacttagaaattctctttaatatttcaacataagcatctttaacattacctaagtctcttctaaatctatctttatctaatttttctcctgttgttgcatcccagaatctgcaagtatctggtgagatttcgtcagctaaaactattgttccatcagcacatctaccaaattcaactttaaagtcaattaagtttatgttttgttctttaaatacagctttaagagtgtcattaatttttgctgtcatatcatagattacttttaattcttcaaaagtagttgcaccaattccaactgcatgataatcatttattaatggatctcctagtgagtcatctttatatgataattcaaatacagtagtcttaagcttaaatccttcttcaagacctaatctcttagccatgcttcctgctgcaacatttctcactattacttcaagtggaactatttcaacctttttacataattgttctctatcatttagtttctctataaaatgagttttaactcctgctttttctaatatttcaaataatactgaagttatagcattattcattatacctttgtcttcgatttgacctttcttttctccattgaatgctgttgcatcatctttgtaatatacaattacttcatcagccttatctgttgcgtaaattttctttgcttttccttcatataacatttctaatttttccattatagttctaccccttccgcattttcctcaatgaattttttcttcatatttaatctgaattcttttaatttattttttaattcatcattattaactgataacatttgaaccgctaacattcctgcattgtagctgttatttataccaacagttgcaactgggattgattttggcatttgtactatagaatataatgcatcaacaccttcaagagctgccttaactggaactcctattacaggaagtattgtctttgatgctattactcctggtaaatgtgctgcaagacctgctccagctataataacttgacatccttgagcttgaatttcttctaatgtttcttctaatttttctggtactctatgagctgaaagtataaacgctttgtatcctactccaaattcctttaaagcatttgctgctcctctcataacttctgtgtctgatttacttccaaaaaatattgctacctgcatttttaagcctcctgtttttgtaatgttcctattaatacatttatatatttctcttaagggctgtaccccaaattataagtgagaatcgaaatctttgatttcacccttcgaacttactcagcgaacgaagtgagtcgagtttcctttaaatatccccaacccgcattacaactataaatatttacatatttatatatttatctatttacatatcttcatatttatctttttaaatatttatatacttaactttatacatatttaaaaatttaactttttacatatatacctttttaagtttttaaatataaaactatttttatattcaagttttatttctacatctttcatcggattgagagttagcaatcaacaagcaattgctagctttcaactcttacttaaaatattctactcctgctttgaatatcttttgatcaaagtctcctgggatgtttctatataaatctgttcctattctttcactatgtgccatcttacctaaaactcttccatctggacttgttataccttctattccgtacattgatccatttggattgaatggcatatttaatgatacatttccatcaaaatcaacatattgagttgccacttgaccattagcaattaattctttaattaagctttctggtgcaacaaatcttccttcaccatgcgagattgcaactgaatgtatatctcctacattaacttcactgaaccaaggtgatttatttgaaacaacctttgtacttataattgaagacatatgtctgtttatattgttgtaagtcaatgttgccatatcttctttaatatcaactatttcgccatatggtactaatcctaatttaattaacgcttggaagccgttacaaataccaagtgctaacccgtctctatttttaagtaattccatcacgctattgcttatcttttcatttctaagagcattggcaatgaatttacctgaaccatctggttcatcccctgctgagaagcctcctggaatcataagaatttgagcagtacttatttcttttgcaagtctttcaatagattcattaagtgcttctttagtaatatttctaaatactacttgagtaacttctgctccttctttttcaaatgctcttgcacagtcatattcacagttgtttcctgggaatactggaattacaacctttggcttagctactttaattgctggagaaagtgttgatttcttatcatataaaactgtttctacttttccttctacatcttcagttttaattttaaatactgagcttaatttttcttcgtatgttttttctaaagcttctatatctaaattcaaatcatattccttagaaattataactgctgaacttattgtcttaccaacttctttatataaacactctttgaattcttctacattaacaccattcttaacttctagtactatagttccatagttaaatccaaataactcatcctttgttaagttttcaatttctgcaccaattctatttccaagtgtcattttagtaacagtttctgaaactccaccatacttaacagcagatgctgaaattacttttccgctttgaattaagttatatagtacatctaagttcttcttaagcttttcgacatttatagttccatcttctagtttttcagtttgaagtaaaactaaacttgatcctgcttctttaaattctggtgatattatatttctagctttttctactcctacagcaaatgatactaatgttggaggtacatctaaatcaccaaaacttcctgacatagaatctttaccaccgattgctgctgtttcaaatgccatttgagcttcataagcaccaagcaatgctgcaaatggtttgccccatcttgaagcttctattcctaatctttcaaagtattcttggaatgtaagtctagcttttctgtaatctccacccattgctgcaagctttgacatactttcaattactgcatagtatgccatgtgatatgggctccaagtaccaagttcaggattaaatccaaatgtcattaatgtagcatctgaactctctccatcaagaactggaattttagcagccattccttctgctggagtttttgcatacttaccaccaaatggcataagtactgttccatgtcctattgttgcatcaaatctttctgacaatccttgctttgatgatacatttaattttcttaaattatttatccattcttctttaacatcaatgtctgctactgtatatggataatcaactggagctttaaccgtaacatttgtcttttgagtagcaccatttgtatctaagaaagttctctttaaatctactatattcttacctctccagaataatctaagtctgtctgcatcagtaacatgtgcaactaaattggcttccaagttttcatcgtttgaaagtcttataaattcatctgcatcttcttttgtaacaactactgccattctttcttgtgattctgaaaccgcaagttctgttccatctagaccttcatatttctttggaaccttgtctaaatctatatctaaacctctgcaaagttctccaattgcaactgaaactccaccagcaccaaagtcattacatcttttaatcatcttagctgcttttgaatttctaaataatctttgaagctttctttcagtaggtgcatttcctttttgaacttctgctccacattcattaagtgaatctactgtatgttccttagatgaacctgtagctcctccaacaccgtctcttccagttctaccaccaagtaagataataacatctcctaaagctggttcttctcttactacattttctttaggtgctgctgcaattactgccccaacttccattctcttagctgcataatttggatgatatacttcttcaacttgacctgttgctagaccaatttgatttccataagaactatatccatgggctgccccaagtgttatctttctttgaggaagttttccttccaatgtatcttcaatcgccactgttggatctgctgcccctgtaactctcattgcttgatatacataagttcttcctgatagaggatctcttatagctccaccaagacatgttgccgctccaccaaaaggttcaatttctgttggatgattatgtgtttcattcttaaacattactaaataatcttccatacctttatcagtttcaatttttacattgattgaacaagcatttatttcttcggaaatatccaaatcttcaagttttcctctttttctaagttctttcatagcaattactgccatatccataagagttttattcttttctttctcgccataaacatatgatctagattttatataactttcataacttgcttttattggagctgtgtatttattatcttcaatttggatatcttctaagatagttgagaatgttgtatgtctacaatgatctgaccagtatgtatctataactttaatttcagttatacttggatctcttttctctcctttgaaataatcttgaatcataagaagatcatcaatactcatagctaaaccttgtccactatgaaattcttttaattgatccaatgtcttgctggtaaatccatctaagatttgtacatctttaggtatgtttgaaagcgatgataaatctttgctatttatatctacttcccttgaatcgactgggtttatataatatttcttaattttttcaatatcatcttttgaaaggtttccttttaataatactactttagctgattttatttcaaccctgtcttctgcggttaatagagctagacattctgaagctgaatctgctctttgatcgtattgacctggcaaatattctacaccaaaagctacttctccttcattcattggtaattctgattcgtaaactacatctactgttgcttcagaaaaaattgtatgtaaagccttattataatattcttcaggtatatctgatattatatatttattaacaagtcttacgtcttctaatccagttactcctaagttatctctaaaatcatttaataaactttgagcttctacattaaatccttttttcttttcaacgaatacgcttctaatatttaacattttaattcctccaaaaaatattatgagatttagcctaggtgcattcaaaaaataccgcatcaatatacttgtatattggacttgctatttttttaatttacctactcactacaccttcgtaatggcgaatgttttccgataacactccactaactttcgtatcgataccataagattatcattcaacacgtatgttgtcaacctattttatgttaaaatttcatttaatttatgttttcgcgaactatgtatttacattgtttttatataattcgtgttttctttatttgctatatatttttatgtattataaaacattttttctttttcttaaatcgtgcaaatttttatagtataaactatcaattttaacataatctacactcaaaaaagacgtagataattatagtgttttctatcaatactataattccctacgtctaaaaatttatttttctatataaaaaataaagagccataagatttctcttatgactcaacaacttactatctgtcgaagtttctgttgtttctttgttgctttctagctcttctacaatcaggacatctaactggatcgttatcaaatcctttttctttgtagaattcttgttctcctgttgtgaaaacaaattcctttccacaatctttacatactaaagttctatcttccattataaaaatcctccctttttccaaagattataacctgatacctagacccaatctctgaaacagaggcgaatgtacagtattgattaaatcttgaattatcttacattcttataataccacactttgccacatatttcaacactaattcgtgtaattaaattatcaaatttaaaccttctcaatttataatatatcaaaacttacattcttaaatatataatttgttaaaaaaaatgaggtttaatccaacctcattcttgatatagctagtcttcttcaaacatcagaccctcttgcaattttccagcatccattgatactattctatctgacacttttttagcaaaatccatatcatgagttataatcatcatactcatgcctttttcacttaaacgctttattaaatttgcaacttccccagttaatcctggatctagtgcagaagttggctcatcaaagcacattattttaggttcaagcactaatgctcttccaatagcaactctttgtttttgaccaccagataattcaaatggatagttatttttctttcctaacaagtctaagaaacctaaagtttcttctgctttctttattgcttcttcttttgaccatcctaacaccttttgtggtgcttcaataagattttctaaaacactcatatgcggaaataagttaaaattttgaaatactaatcctatatcttttcttatttcttttaacgcatttttatctacatacttaccatttttacataaaacttttccgttaacttctatatcgccttcatcacaatgttccaattcatttacacatctaagtaaagttgtctttccgccacctgaatttccaacgacaactaatatttcacctttttttatatgaagattaacaccttttaaaacttctgtatttccgaatctctttttcaaattacttactttaagcatataatctcctccacactatttataatagtcatacttctcttcaattttctttaatacttgactgaaaattgctattactactaagtaaacagcaccaactattaaaagtggtaccaacgaaacatctctattagcagcagtcttacctatctttaatagctcgtccataccaactacataaactaatgaagtatccttcactaaagttgttatttcattcgcaactggtggcattactgttttaaatgcttgtggaagtattattctaaaaaatgtttgtttagaacttaagcctagaaccttagccccttcaacttgtccattatctatagactctatacctgctctaaatatttctccaaaataagctccataatttaaagtaaacgctaaaattgctgctggaaatctatcaaagctgattcctactagaggaagtccaaagaagatcacaataatttgcaataacagaggagtgcctctcattataagaatatatattccacttatttgtttaagtattagagatttagatgtcctcattacagcgattattactcctagcggaatagataatactaaagtaagtacaaaaatttctaatgtaacttgtaatccctctaatacttgaggcattatctctaaaatataactcaaagttatttcctcctctttattttcaaactatttgtataaatatttgtgattatctaatttgcactatttaagaattatatcttgttcgaaccatttctttgatatgtctgctgcagttccatcagaaatcacttcatctaaagctttgttaaaagcttctacaaatttagtatcaccttttttaattccaacaccgtacttttcacttccaaaattatcagttaagattttatatttttcttctcctcttgctttcatataatatcttgctaaaatctcatctacaacaatggcatctaatctctttgcttctaaatccattaatgcagcgttattatcttcaaacgtaacaagttttccaccatcaaaagttttttcgattccattagctgcttcaactgcatctactgctgttgatccgttctgagcaccaacttttttacctgctaaatcatttttagattcaatattagaatctgctaatgttactataacttgagtattacttaaatatggctttgaaaattcaactttttcttttctttcatcagtaattgaatatccattccatattaaatctatattaccgttattaagttcagtttctttcatactccaatcaattgattgaaatttcacctttttattaagttttttacctactgcatttgctaaatcaacatcaaatccaactatttccccgttctcattcttaaatcccattggaacaaaagtatcatctaaacctattactaattcatccttatctaatgcactttttgctgcctttgattctgatgatttattggcattcccgccacatgcaaccaagcttactcccaatgtagctatgatagcaactactgttaatttttttattaaactatttattttcatatgtaataacccctacatcactttctatttatcactttatcatactaaagcaaaagaatcaagtgttttttatattctaaattataacaggtataacgaaagctacattagcccattatacctgtcaaaaacttggaactatacattttatctagtggttgctattctatctatcgctctttcaaggttattcatatgtgatgtaaattcatctactgtatctgttacttgctttttatcaattggatccttaaatgtatctgctctatcttttgcatcatcaacattatctttaatttcatctaatttattagatatatcatcaaatttatttttaatatcttcactttttccttcaaaatcagcattattgagctcatccgttaattcatctgctttatcatttaattctttcattacacgtgtagtatcactatctacttcattaactttatcagaaatttccttagggttagactttaatttatccattaattccttcatcttatctgattcaaaaacttcattaaccttatctgcagatggcttttcatctgtatcttcttttgtttgaagtatataatcatctttaagattacaaccaattaaagaaaaagaaagtattaataaaagtacaaagctcattatatttttctttttcatttcttcacctcagtttgtttttatactacatagtctatattaatatttttttgctaatctttcaataatgaaattaaagcacaatcaaaaaaataacaagtccatctgcctaaagtgcatttttcaacttagatagtaatctttttttatattttatacttgctacttcacttatatctgctagtaatctataatttgatattccaccatacactcctactataggtatcccttgaataacttttggcactactatattttcagataaacattttgaagccgaatcaattaattcatttatatcaaccttaagatcaagattattttcaatactatatgcaattctatccgcttcatttgagtatagaattttttcatctgtttttatagaacttgcacaaattatatttaatataaatgccttctcacttttggacttataatcaaatccataattcacacaaatctcatacacagtttttaatattactccaataaatacaggtatatccggtattccaattcctaatataccaagtaatgtcccttcagctgctgtgattcctttatttataagcacaccctttttcactcttttatctattctgcttaaatttttgttattcatctgcttagataaaatatattcatctatatctgcttcatttttaattttctctgagttataacttttctctattactgtagtgcctttttcaaaaacataataaaatcccttttcaaatgctttctcaaaagtttctatcatatttttcgggattttttcttctaattgctcttttacaggtaatatcttattttttatatattcattttcttttttataaaagaacttgtcttctctttttattaactttttcatttgactatttagtattctctcttttcttttatccctataatccatgcgcagctataccgaatcccttctataaataataaattactgtatttaattaacctacttatataatataataattgcaccaaaaacggtatttcaaacataattaattgatttacctaaaataatatatattaaatatgtaaaagttcaagcaaataaattaaaatttgcacgctctacattgtttctctacttagatgaaacttgactcactttcgttcactgagtactcacagagtaagcgaccatcatcgaatcataaattcgagatgccttcttaattgattcacacaaaatcaaagattttggttcactacctaaaagagagcaattatcttgctctcttttaagtgtatttagtttattatttctttcctgatccttttagcatttctccaattgcagctatactcccaagagatgataaagtctcatttggtaatataagcttgtttgctggactgttagccatttctttaagtgcttcaacttgctttaatgctataacagtttcatttgttccagactcaataatagcttgatttacttttcttatagcttgagattctgcaatcgctatttgttctatagcctttgctttaccttctgcttctagtagctgagattcttttaaaccttctgctcttcttatatttgcttgcttttctgcttctgctgataagatcttagcttgtttttctccttctgctttttctatttgagattgtctcaaaccttctgcttgaagaatcatagctctcttatctctttcagctttcatttgcttttccattgcttgttggatttcagctggtggaactatatttttaatttcaactgaaagtatctttattccataagcatcagtaacttcatcaataatgcttaaaagatcttgatttatactatctcttcctgataaaatttcatctaatgacatattacctaagatatttctcatattagttgtagctgagtatacaatacctgattgaaaactttcaatattataaactgcatctcttgcattcaataccttataaaatataacattgtctactaatattttaacattatctttagttataaccgattgtggctccacatctaaaatttgttgttttgtagaaatcttccttctaacaaaatctacaaatggcacaataaaatgtaatcctggttccaatactctatggaattgtccaaatctttctacaacatataaatgccctgtatttacaaccttaattgatgagataactactattaatattaatagtaaaataacccctaaaattataataacactcataatctagtcctcctgaaccttttcaatttttaattttataccttctattcctttgatagtaaacttgtcccctttgtgaataatatcgccttcatttattacagtccaatattctccaccaactttaacttgggctttatctataatctctttttcgcttatcataatttttcctacatatgtttcttccattagtggtattctttcgtttgctgctttaaattttttcttgagtaacgggtatccaactgcaaatgatattatatttagtacagaaaatactattatttgaattataaatggcacttccattactccacacactgcagctacgacagcacctactgcgaatagtgtaaaacaaaaattactagttaaaatatctattgcaaatacgcatatagctataactaaccaaaaaactgccgcccccatacaacttccctccttaaaaacattataatattagttctaagatttactgtccaatttttacatacatacttgaatttgtaatcttattttatattatacagtacatttatgaatatttcaagatatttattaactcaaaaagagttattttataccttttatctttttttgatttcacaaacatgttagtatataattattaggatatgtttatgtttactaagcaaaatatacttaaaacgtatttaattatattagaactatatcttataaaccaataaaaaaacttaaactttataattgcaaggagtgattaaatggattttataaaagtcgcagctgcttgccctaaaactagagttgcagatgttgattataatgttaaaaatattttacagtgcatagatgatgcagtaaaaaatgaaagtaaatttatagtttttccagaactttgcttaactgcttatacttgtggagatctgtttttacaagaatacttgctaaacaaagctttagatggaatttttgaaatattagaatctactaaagactatgatactttaattgctgtaggtgctccacttctctgtgaaagtactttatacaattgtgcctttttattatttaaaggaaatgttttaggaatagttcctaaatcatatcttccaaattacagtgaattctacgaaaaaagatggtttactgaaggtctttcaattgaggacgaaagagtagatttaccatttcaaaaagatgttccttttggagtaaacttaattttttcatcaagcattgcaaactttggagttgaaatttgtgaagacttatgggtaacaattccaccaagttcttatctttctcttatgggagctcatataattggaaacctttctgcatcaaatgagcttgttagtaagatggattatagaaaaagcctaatatcaaatcaaagtgctagatcaatctgcagctatatatattcttctgctggtgttcatgaatccactacagatgtattatttagcgggcatttattaataagtgagaatggttcattattaaaagaaaatgacagatttcaaagagaaaacgaagtaatatattctatagttgatgtattcaaattaaagtctgaaagaatgaaaaatttgagttttagagattcatctaagtttatcaataaaaaacctaacacaattaaatttgaatttagtgatgtttcaataagtacatttgatagattcgtagataaacatccatttgtaccttcttacgaaaaagaaagagaagttcgctgcaaagaaatatttaatattcaagctgctggcttagcaaagagattagagcatacaggatcaaaaaaagctatagttggaatttcagggggattggattctacattagccttacttgtaatagtaaaaacttttgaattgcttggtattgacaaaaagaatatagtaaccattactatgcctggtttcggtactactgataggacttacaataatgctattaatttatgtaaggaattaggtacagaccttagagaaataaatatagttaaagcatctcttcaacattttgaagatattggtcatgataaagacattcatgatgtaacttacgaaaatgttcaggcaagagaaagaacccaaattttaatggatattgctaataaagaaagaggactcttaataggtactggtgatttatcagagcttgctcttggctggtgtacatataatggagatcatatgtcaatgtattctgtgaatccatctattccaaagactcttgtaagatatttagttcaatacgtagctcaacatgagtcaaccgaagttgtacgtgatattcttatggatatactagacacacctgtaagccctgaattattacctaaggatgctaacggtgaaatcgctcaaaaaacggaagatattgtaggtccttatgagcttcatgatttcttcttatatcactttattaaacatggctcaactaaagagagaatattctttttagctagggctgcctttaaagatgattactctgatgaggaaatacaaaaatggcttgataaatttatttttagattctttactcaacaatttaaaagaagtgctcttcctgatggacctaaagtcggaagtatttctttaagtcctagaggtgactggcgtatgccatcagatgctaagccttgggaataatctactattatatataatttgatgaaaaaccttaattgatttattattagattacttaaggttttttgatgtggacattttttcaaatgtgaaaagttcttaattgtgctttacacttttttcaaatgtgaaatgatcttggttgcacttcgtgctctttttataggtgaaaagatcttaattgcacttcgtgctctttttataggtgaaaagatcttaattgcacttcgtgctctttttataggtgcgtacttttttcaaatgtgtggaaattttttttagatagtgctaaaatagatgttattaaataacaataataaacaatggcaataagccttatagatttggaggaatataaaaatggggaaaaaagctgatatagactggggtaaattaggatttgattacataaaaacagatcttcgttatatttcagtttggaaagatggaaaatgggatgaagggaaacttgttgaagacaatatgcttagtataagtgaagcttctacggttattcactatggccaaagttgttttgaaggacttaaggcatatacaacaaaagaaggcaaaattcaattatttagacctgacttgaatgcagatcgtatgaatgaaagctgtgacaaacttcttatgccacatattccaaaagaaaaatttatcgatgcggttaaacaagttgtaaaggcaaatgaaaaatatgtaccaccttatggaagtggtgcaactctatatattagaccatatttaatgggagttggtaacaacattggtgttaaacctgctccagaatatatcttcggtgtattttgtataccagtaggaccttattttaaagatggtgtatctccttgcaattatatagttttagatgattttgatagagccgcccctcatggtactggcggaaataaagttggtggtaactatgctgcttcattacaagctcatgctgaagctgtaaaaaaaggatttgctgattgtatttacctagatccagctactcatacaaaaatagaagaaataggtgctgcaaacttctttggaataactaaaaatgatgaatttgttactcctaaatcaccatctattttacctagtataacaaaaagatctcttctttacattgctgaacattatttgaaaatgcctgtttatgaaagagaagtatttattgatgaaatagatcaatttaaagaggctggtgcttgcggtactgctgcagtaataactcctattggtggaatccaacataacgataaattgcatgtattctttagcgaaactgaagttggtcctataactcaaaaattatatgatttacttttaggaattcaacttggtgatgttgaagctccagaaggctggatatacgaagtagaataatacttataattataaaataaagtaaaaaaatagtatgaacttagcccaaaataagttcatactatttttttatactattatttagaaccactgtatcatatctttcaattgaatttgaatctttcattcttaaataagtacttaagctttagaatcttaagtataaatttattatatcatcatatattttactctcttattatattatatatgttgcaattcacaatgccatttcacaattcacaattacagctaaaattcttttaatatttttataattatgatgaataattatttttgcaacgtatatatattaagcaaataaatatatattatattatagaatatttagtaaacttttctagtaaatatacgaatatataagtaatatattgaagctgaatttataattttagggaggggatattatatgagtgataacagaataatttctagaagtgaatatattgtggctagtgtatctggtgctgctattgataataaaataataaagaggccttatactaaccctagaaatccttccaacaaaaagcaaaataatgctaaatcttttgataatactttacattcatcagcttcacaatcacaatcaactgacaaccaagcgtctttttccaatgaattagaaaatatggcaagattgaaaagcgaagaaaactctaggttggttcaggcaaaattcaacaataaaataaaagattctgaaactagcgagaagaatcctgctgaaactgaattgcataacaaacttgctcaagctatggatgttgatgtggatgtatctactctatataaaaaagtacaattactaaattcattaaaaaatgaatctaataactaataaaaggttgccaaaacatatggtttttggcaaccttcttttatctaaagtctaaactgctgctagtctatgtagattactatactctccttgtttctccattaattcttcgtgggttcctgcttctattatacctgtttttccaagtacaataatttcatctgcattcttaatggtagacaatctatgtgcaactactatggttgtccttccagcgcataacttttctagggattcttgaattatgcgttctgttgcattatctagtgccgatgttgcttcatccaaaatcaatattggaggatttttaagaaaaactctagcaatggaaatacgctgcttttgcccaccagataatttaacacctctctcaccaatgtaggtatcatatccttctggcaatgtatttataaattcatgaatattagccatcttagcagctcttaataattcttcctcagttgcatctgtctttccaaacagtatattatctcttattgttcctgtaaataagaaaacttcttgctgaactattccaatattctctctaagagaatctaatttaacatcataaatactcttattatctattaaaatatctccactatcaacttcataaaatcttgggataagattacaaaatgttgttttacctccaccagaagctcctactaacgctaacatctttcctttatttatcttaatagaaatattttttaagacttcttttccttcatagctgaaattaacatctttaaattctatttccccttgaacattttcaagttcagttgcatttgctttatctttttctttatcttgactcattatttctatatatctttggaaacctgtaattccattttgaaattgttccataaaatcaataagtttctttattggggtcataaagatttttataaacagcatatatgccataaaatctccaatgtttataagtccaataagtgtaaatattcctcctcctattaaacctacataacttagcacgtccattccaaatcctgcacctgaagaatattctgccattactttgtatgctctttctctggcattgatgaatcttttatttcctttttcaaatttttcttcttcagcttcatgacttacaaatgcttttgatatttttattcctgatatactattttcaagatttgcattgactgctcctgtctctactttagtttcaagaaaagctttattcatcttctttctctcatacaaggtgaaccatactataaatggtatgaatgcaaatattaaaactgtaagaggtatattgattgtacacaatattataaatgaacctataagcataactattgatataaataaatcttctggcccatgatgagcaagctctgagatatccattaagtcattaataattctagacattatatctcctgttttattattatcaaaaaagctattaggtaatttttgaaggtgcttaaatatatgtcttctcatatccccctgcattctaacacctacaacatgtccccaatactgcatgaagtatccacatgcagccttgattccaaaaattataagtaatgctatggcaaatacaataattgtccttaaatctttattaggaatcgattcatttactagatcccttgtcataactggatatactaaatcgcataaagatgcgataagtgctactactaaatctaaaataaataataatttatacggtttataaaatgaaataaatttttttatcatttaaaatctccttcctctaatgaataaaattcatatggcttgtatatactttaatataatacataatttcccaattgtaaggtggtgaataacttttatgaaaaagctattttattttgtaagcttctgcttagcaattctattgcctttattttcactaaatatcatagcaagtaaatctgatccagattattttttcccattaatctttatttgcttaggcctttgtgatacattgcttggcattaatttattaaatgcaaataaaaaatttttgggtatttccagttttgtaatagcaagtttcttattcgttttagttggaagcaaaatttgtatatataattaaaaatgtgtactagtagtgcattcctactatataacttttatattatatttaaaatttcttccttacatttatctaaattctcaatgaatgttcctgctattttaactggtctattgttaaatactattatattccctcggaaatatatagcttcatctagatcatgagtaaccaatataaccattcttttttctttatctaataaatttttaaattcatcaattatggcatatttcaacttataatctaaagatttaaaaggctcatccattaaaatgacctttgatggctttccaaatgctcttgctatgttaactctttgtctcattcctccgctaagtgcatttggatatttgttttttgtatcgtaaattccaactaaatttaatacttcatcaattctattctctaaatcagaatccttgaaatatttttctaatgcaatttccaagttttctttaacagtaagccactcaattaacctatcttcttgaaatatatagcttatatcacttaatgaaacgccacttatctctccactttgaacatctattagacctgctataatgtctaatagagtactctttccacacccagattttcctattatacaatttatcttatcgtcgtaaaaatctatgttgaaattctcaaaaattttctcagttccatatgacttatttagatttttaatacttatattcatttggaccacctatatgttcttttccttaacaacttatttaaaaactctaaaactagagatacaatgacaataattacaatccatgcaaaaatccctggagtattaaaattaactttttctacctgtatctgtgatcctatcccaaactttggctgcccgtatacttctcctgcaattacaactttaaaagtcaatgaaaatgtcgatacaaagatgctcataaaataagatttcatagttggaatataaatctttttgattttgtttcttaagctcacttcatatatcttcgtcatatctattatttttttatctatttgcaaaaggttatttcgtataccttcataaagtattggaaaaatgatagcaaatcctgcaacaaatggtgtactatccttatcaaaccacaccaatgaaagaactactaacaccatagttggaattgtcttgctaaatgaatttacaggctccattaaatacttgaaaaagggatacactgttgcgagcacccctaaaatcattgaaaaaatcaaagctaatacataactagtcgtagtcctgtaaaaactgctaaaaattatctttaacgaatttttatcaccaaaaatattcttaataacttctaatacttgttctaatcttggaatatatatgtcattatttattattactgcaattagctgccatatccctatgaaaaatatacatgatagtaaagtatataatctacttttccatgaatatttcatcatttggtatacttcctcctattgtttttgaatcaaattcatttaattttttaaaataagtttcatattctttataacaatcctttattcctacgtattttatatttgacctatcaatagcttttactactattggcttctttgccgaaactcctatttcttcgcaataatctccaacagtttctttattattatatatccactcttctgaatctttaacttgcttcaaaagttctgaaacaaattccttatcattttctaacaattccttcttaactataattgttgattgaggatatccatattgagagtcgtttaattttttccattcttcatttaaatttagcattacattaaacttatcatttttactctgaactgttgataaagccggttctggaattactgcatattctgactttccagataaaattattggtgcaagctcatttactgtattcacatagctaaagttaatttctttatctacatcaatacctttttctttaagtattgttcttgcaattatatcaggcgttaatcccttcccaatattgtaaacttcttttccttttaaatcttcaacactttgattttgattagttgtgcctatataaaacgatccaaatccaactgttcctgctattttatattccttgttcttattaaacacagttgccgccacgtttgaaggaacaattgcaatatctggctcactcttcataacgcttgtaactaagctgtcagagttttgctcaatagtataattaacattgtatccagatttaatttccggtttttcttttataagtttagctactgctatagctgtaagcccatctggtgttacaaagctaatatcttttgttgatttcttattatcttcagatttgccttgatttgagctactgccacaacctgcaaatgtaaacacacacaatatcatgattaaaaataatgataccttttttttcattctaattcccctaaaaaatattaatatctaaattaagaattaaatcaaaatacttaatagtaatattaattaattgatattcactattaattataataacatattaaaattgaaataccaaatctgtatggatatccaactataatctatacttatgcgtatatctcaccgaaatgaataacatacttttgttccagtttctaggtaattctgatgggtgattctaaggctataaagttgcaccaaagtgctagcctcaaagaacaagctttgaactagcacatttggaatagttgaaaggaaactcgactcacttcgttcactgagtaatttcaattgaccaaatcatagatttggaatttcaattaagaatcacttccatcaaaattaccaatgaaacattccacaaaagtatattactcatttcttgttagaagatatttcatagtctaagtatagtttatgattatgtcatctataatttcaataaagattaaaaacgacaaaagaacatgtagaataattattaaacatgttctaatatatttctctttataaaaaatatacatttatgtacttactgaaattagatttccacattcccatcttgattgaacgattaacttaatagccttgtaaatgtgaatatgttattgcaacacgtatatcatttattatctatatatatcaacaatcatcccttgaatttcatcaattgttgacgctatatttatattatctttttcatcagaaaggagtgcttttgttaattcttcaagttttccatcaacagtatcaaccgttacgaaatactgagtctgccaaaagctaatatcttttttagtctcatacatgaactttagtatcgattctaaatattcttttatcatctttttatacataaccacatcaacataagtcttagtagttactaatctgttgccccttttttttatgtcatctatcatttttttgagttgttcttctgattttttatgtctttcctgactaaaactttgggaaaaatcttttttttcagaaataatttttctctcagaagttacagtccctcttcgcactctaccaatctccatgtatattcaatcctttcctaactcaaaaataaagtttatctaaaagtttaaaactctaaaaatagctaattacgctctattgtatatatgttgcaattcacaattacagctaaaattcttgcaatatctttaaaattatgatgaagaattatttttgcaatatatatatttaattaattatatcaaaatccagttattttctctacttaatatttgattttgatatgtatatttcattttttcccatgtatataaattcattaaacctctaatatatatatgtatatactaaattatgaatggagtgatgttatccatgtggtttgatgcaccttcacaagaagttctgcaaaaattaaatgttaatcctgatgttggactttccgaatcagaggcaaaagatcgccttgaaaaatatggagaaaacaaattagcttctcaaagtaaaaagagcctttggcagctattcttatctcaaataaacgatgttatgatttatatacttttagttgcagcaattatttctgcatttatgcacgaatatagtgacacaattgtaatactgcttgtaattttaataaatgctctaataggagtgtttcaagaatctaaggcagagaaatctctcgaagcattaaaaaaattatctactccaaaagctatagttaaacgagatggtattataaaagaaataccttctgaagaagttgttgtgggtgatattattatactagatgctggaagatatctccctgctgatttacgattaattgaaagtgctaatttaaaaatagatgaatcagcatttactggtgaatctgtccctgcagagaaagatagtaatgtcacacttacaaacaacaatattcccataggtgacatgataaacatggcttttatgtccactctagtgacttacggccgcggaactggtgttgttgtaaatactggaatgaatacacaaataggaaaaatagctgatatgctaaataaagaagaagataatacgactccattgcagcgaagacttgcatctcttggaaaaactttaggctttggagctgtaggtatttgtatattgatctttgtaatatcaatgtttcaaggacgagattggttcgaaatgcttttaactgctataagcttagctgttgctgcaattcctgagggccttccagcaattgttgcaatagtactagcaatgggtgtacagcgaatgataaaacaaaattctatagtaaaaaaacttccagccgttgaaactttaggatccgttaatataatatgctctgacaaaactggaactttaactttaaatgtaatgacaataaaaaaatgctgcataaataataaacttgcatctattgataattgcgatctaggtgataatgatacaaaattgttgtttgaaggaatgattttatgcaacgatgctacttcaaaagatggtagtaaaacaggagatcctactgaaattgctttgctggatgctggaatcaagtatgatttatataaagaagatttaagcacagatcactcaagggttgatgaaattccttttgactcagatagaaagctaatgactactgtaaataaatacgattcacattttaaagttttcaccaaaggagctattgataatttacttaaactttcaaacaaaatcttattaaatggagaaataattgatttcacacaagaaaaaaaggatgaaatcctaaaaatatctaatctaatgtctgacgaagccttaagagtcctcggtttaagctataaagacataaaggatgaaagcgtcagcatagattctctcgaaaaagatttaactttcgtaggattaatgggaatgatagatcctcctagagaggaagttaaaccatcaattgctttatgtaagcaagctggaataactcctattatgataactggagatcataaaaatactgcttttgcaattgctagtgaacttggaattgcaaatagtataaatgaatgcatgactggcgctgaaattgatagctatagcgatgaagaatttaataaaatagttaacaattataaggtatttgctagagtttctccagaaaataaagttaagattgtaaaagcatttaaattccatgggaatattgtatctatgactggtgatggcgttaacgacgctccatctttaaaggctgctgatataggtgttgctatgggtattacagggactgacgtcgctaaaggtgctgctgatatgattttaactgacgacaactttaccacaatagtcaaagctgtagaggaaggaagaaatatttatgcaaatataagaaaagctataatattcttattgtcctgtaacttgggcgaaatagtttctttgtttgtagctattctattaaattttgatccaccattattaccaattcatattttatgggtgaatttaataacagacagttttcctgctctttctcttggtatagatccaaaggatccaagcgtaatggagcatccacctagaaatccaaaagaatcactttttgcagaacacatggggttatttctggctttaaatggtgtactaattggtggtgtaacattagctgcttttcttcttggtgaaagattgtatatgagctccctagttcatgctcaaactttagcttttgtagttttaagtttttcccaattatttttttcactctctatgcgaagcagagaaaaatctcttttaaaggttggactcttcacaaacaaatatttattgctatcaattctacttggtatgtgtgttcaatttctaataattataattcctttctttgctgacgtatttaatgtatttattttaagtgccagagattggcttctagtaatatgtatttctttaatcccattcttgcttaatgaaatatttaagttaattaaatatcatagataagcataaggtaattaaaatattacatttattacaatattttaatgatcaatttttatgaatattgacaaactttttttatctttttaattatagttgaaacaagataatatctatagtacaatctatcatataaaagggatttaggaggtattaaaatgataataaaatgtatagataatgatctttgttcaactttaactttaaataaggaatatgtggtcatagaagaagcacctgaatattatgtaattattgatgataaaaatgatgaaacaacttgcagaaaatcaagatttgaaattattgaagatggtggtttaactaagaaagctaaagctactattacagaattaacttatcaattagaaaatgattttaaagacataaaacaattttcaattagaaaaaattcaaaaggtgaaattaaagaaatatctgtaaagttcaaatatatctagaaaaaagttctgctggaaggcagaacttttttaattcacaattcacgattcacaattcacaattaaagattaaatttttagatatatatttttaaaactccaaagtagcttacccataattgtgcattatgaattaaaaattaaattagtagattaacattatattcttcaagccaaatatttacttgaatcaagaaagcaagcaattgtggtccagtcattagctgcccataccatggagctttatatgattctccttttgtgagtattatctctctaactaccttttcatcaatgatttcatgaattggtgaagatttcttatctaaaatctcagttatcatcttacatacaatgtctgtataaactggattatgtgtcttaggatatggactcttctttctgtatataatgtcatttggtaatattccttcaaaggctgctcttaataatcctttttctctgcctttatataattttacatcagctggcaagttgaacgcataatcaaccaatctaatgtcggcaaatggaactcttgcttctagtccattatacatactagtcctatcttttcttgtaagaagctgaaccatgaaccattttagatttaaatatgacacttccctcatcctataatctctcttactctccccatcaagatgagggactttacttagagatttttcatattgagttctaactaattcctctagcggcatattttttaatttcttattaactatagcctttctatcattaacaaaccttgaccatgggaatgtatctaaatagaacatttcatcccttgtaaaccaaggatatcccccaaagatttcatcagcacactctcctgtaagtccaactacaaagtctttacgaatttctttacaaaatagaagcattgatgaatcgatatctgccataccaggtaagtctcttgatatcacagcatctcttaatgcagctgctaaatctgaatgattcaaaactacttttctatgatcactatttataaactttgccatttcttctgaccagtattcatctgatgtcggttgaaataatgacgctttaaaatacttttcattgtcttcataattaatcgcataagtagtaagcttctttccctgttttctaaattcctcagcagctattgctgatataattgaggagtctaatccccctgataggaatgtacaaacaggtacatctccaactaattgtctctttactgcatctattaataattctctcgcatgaactattgcttcttctgctgtttcatgaaattcttttgcttcaactgtccaatattcccactttttaatgtttccatcacctgaaactaataaacagttggctggtgcaatttcttttatattcttaaatactccgcttcctggtattgtcgcaggtccaagcccaaatatttcagttaatccttccatatcaatttctcttttaactcttggatctgctaaaagagtttttatctcagaaccaaaaacaagggtattatcatgaacagtatagaataatggcttaacccccatttgatctctagctaaaaaaacttctcttttatcttcatcaaaaactccaaatgcaaatatacctataagcttatttacacagtccttcccccaacaaatatacgatgtaagcaatacttcagtatctgaataagaatcaaaagtaaatcctttagcctttaattcttttcttaaatcctcagtattatatagctcaccattataaaccaatgtgtatttcttaccctcaaatattttagtcataggttgcaatccaccttctggatctacaactataagccttctatggcctaataaaacatttggagatatataatatccttttgcatcaggtcccctcttctccaaagtctttatcatattatttaatatatctttatcttgtactatattctttttaaaatttactaatccagcaattccgcacatccatttcaccttctaatagtattgatactattaaaatatgcacatttataaaaagtgcgatagcacaattaagatcttttttactttaaagaaagtgcgacagcacaattaagaactttacacttcttgaacaagtgcgatagcacatttaagatctttttactttaaagaaagtgcgacagcacattaagatccttacacatttgaaaaaagtacgcacagctaaaaagagcacaaagtgcatttaggatcctttcacagttaaaaagagcacggagtgcaattaaaatcatttcacagtaaaaaaaagtgcgaagcacaattaggaacttattaatcacagttaatatcttttcacttctgaaaaaagtatactcctttaaagagatcacacagttcaaccaatatcatttcacacaaaaaaagttcgaaccacaattaggaacttatcaagtacagttaaaaactttgcgtacaaaaagtgcactatacccaaaaaacttttcatatttataagaaatgcatcacctataaaagtgaaatagcataaaaaaaacttctccctctaataattgtataaagaattataaacttatatatttgataaacatgaatactatttcttatctgtaacatactagatatgtatatttaaatagagagagaaggtaaaataattgaatgttgcaaacaattaccaagcaaatattgacttaattcattcaaatttagttgtagataaaagtttcgatatcgttgaacgaaacttcattgttgggggaagaagctctgttttatattttttgaatggttttattaaagatgctatcatggaggaaatattaaaatctttctttaagataacacctgaaacaatgaattcatacaaaacaattgatgactttatcaataataaagtttcacacgtatccgttaaaactgaaactgatttagacaaaattttaatcgcgttattatctggccaaacaataatgtatgttgatggttatgattcatttatactattagacttacgtacttatccaggttcagattcatcaaagcctgaaaaggaaaaaactttaagaggtggaagagatggcttcattgaaaagttagtatttaatgctggtttcattagaagaagaataagagatcctagattagtttttgatatacatcaagttggtaatgtctcaaaaacagatgtatgtatcgcgtatatagatggagtagcagataaaaaagttcttgatttaataattgatagcatatcaaaagtagatataaaagctttaacgctttctgaccaaagtttagttgatgtaatgtgcacaaaaaattggcttaatccatttccaaaggtaagatttaccgaaaggcctgatgtagctgctgcacatatagttgaaggaaaaataattattattgtggataattctccaaacgtaataattctcccaacaggaattttcgattttttacaagatataaatgattattatttccctttattcactggaaactacctaagaattgttagaaatttcgtaatgttagcgacaatattattaactccagtttacttaatgattgtaaatgggaatatttttataccgagttattttgactttttgaaaccgcaagaggaatttgctttgcctctgctcggtcaattcatgcttttagaatttgctgttgatatattaaagctggctggtttaaatactccaagcccacttggaagtgcaatgtctttgattggtggtttaatccttggtgattacgctgtaaaaacaggctggtttattcctcagtctatattatatatgtccatcgttaccataggagactttactcaacctagcatagaaatgaattttgctttaaaatttgcaaggatgattttacttatactttgtggattctttggtttctggggctttataggtggtattatattcattctaatagttatggcaagtacaaaaacaatagctggtgataaatatttctatcctttaattccatttaactggaaagctcttaaaaatttattattcagaacacgaatatcaaacgatgtgcaataagctatgtaaaaaaagtgataagttaatataaaacttatcacttttcatttgtcacttataaaagtctagttccctctttatcctgtgtaattagtttctctctcattagcccgcctaatgtcattttaaaataatttttacttgtattaaattctctctttatatcatcaggtgacgatttatcattataaggcataaatccaccatttgcttttaaataattaagtattgtttcacttaattcacttcttgcttctaaccttttctttctcgttgtaactccaatagtcccatcttcataaatcctcttaactcttccctttatttcctgtccaggatatatgtactcaaaatgttcatttgctaatattaaccctctatattcaccatctattgcaacatttaaagttgcattctcatttatttcataaactatagcatttacttcatcagaaactttatatttaccttcttctgctatatctaaataagaatgtattctagtagttgccgctaatctatcagttttatctacatacatataaaatagatatttttttccttctttaagcttgtaactttgctcttttaatgggacgaataagtctctttcaagcccaaagtttacgaatgccccaatattattttggcttacaacttctagataaccaatctctccaactgttaataatggtttttttagagttgaaatcatcctatcctttgaatctctataaatgaatacttctaattggtcgccttcttttatttcatgtccctttgccgcactgtttggaagtaagacctcatcaccaaaattatcttcaagataatatccaaagtctacttttttacttacttttaatttactatattgccctactgatatcatttttaatttcctccattaatcataacaacttaatcgatgttatcttctttattacttttcttgatcattctatatattgaaattaactttctacattgctatcctcaatttggtactcacattactagaaccttgaatgtaaatttattactacacaatatgataataacttgtatcttttctttatataaaacatgttaaatctaaattacttgaaatctttactcaattccagataacttatatatgatttcttaattccttcaatttcttcttgtgttaactttcgtatcacttttgctggatttccaagtatcaaaacgccatcttcaaattctttattttgagttattaaacttcctgctcctataattgtattattgcctatttttgctccatttaatattactgatcccatacctactaaaacattatttttaatggtgcatccatggattattgcgccatgccctatagtacaacaatctcctataactgcattatatccataatcaacatgtaccacacaattttcttggatgtttgtattttctcctatagttattgatgcttcatcacctcttataacagcaccaaaccatatattcgcatttttcttaagtgttacgtctccaataattactgcagtttctgaaacataaatatcgctatccaaaacaggttttttgtctttataatttttcaccataacaatcacctcactaaacactaaggttattttaacattacattcacttattgtcattattttgctcactttagaaatacgaaataaaataataatttaaaccataattaattattaattgtgaattgtgcattgtgcattgcaatatatatatactataaataatttttagaggtaataactttggggaaaaaaaaatcacctaaaaataagcttaatatagatgatctgaatttttactatggaattcctcatgctcattgcaatttttccactggacatggaactccaattgaagcatttgattatgcacgacataacggccttaatttccttatattaacagaccataataatcatttaacaaaaacaataaaagtaaaaagctctgagctaagtagatgggatgcgctaaaatatttaactgttcgttataataaaaaacatgaaaactttttagctgtggttggttttgaaagcaaaactaatccgtttggagacattaatgtagtaaatccaaacaggttctttactggaacagtaaataatatgcaactattagttttatggatgcttaataatcctaatgcatttatttcaattaaccatccccacaaaacaataacatatttagaatacaactctattttaaataaactaataacttcaatagaagttggaaatggatcttatccaaacaagtatttaagatatgaaaaatattattaccatttactcgataaaaactggaaactaggcgcaatcaatggtcaggataatcatagattaaactttggtgacgatgaaaatttaacatgtataattgcagaagagcttacaactcagtctctagtcgacgcttttagaaaacgacgcacttattcaacagaatccagaactttaattatgtactttacaataaataatgaatttatgggcgatataatacctatggaagatgataatttacaattttcaatttttgctcatgatcctaatcacaaaatattagaaattgatataatatctgctggtgggactataataaaaaaaatatctaacttgaatttaaataaagtaaaatacttgtattctcacgagcctttaaaaaccgagttgtggtatgtaataaagataacactggataataacaaaatcgctattagttctcccatttttagaggtccagaataatattatttatatacttaaatatatatgtttcagtgcacaattcacaattatagctaaaattcttgcaatatctttggaattatgatgaagatttttttgcaacatatatatattctaaaaaaataattcatataaaaagaaatagaatatatgatttcaaaacatttacattgttataaatcatacattctatttcttttctatgtttctatttattttttttaactctatttggtttagcttttggcttaatcactatttgcttttcttttttcttaagtccgcctctttgtgtaatatccatgaaccataagaaaaatagaactgcaaaaatagataatccacttgaaatataagtatttgatgcacctacgaatatttgggccgcaaataatactgcagctatcgctaaaggtatccacttatttatacgcactttaccaaatataaattttttgcatagtgcatatgccacaaatataacaagaagcattaatacaaataaaataattgatgtaaaaagattcatctactcacatatcctcctataaaaagtctatatggttaatgataatttatatataaactattatcaagcattccttttaattgttgttgatttcatcagtatacattataatcaaaaagtaataatttttattaaaatatcaatattataatttttttttaacaaatttatagttttatctttaattattcgcgtatatttgataaaataaaaaaagtatatgatataaaagatatgaggtgatataatgaatttaatttcaaataatcatttagatgaattagatttacaaatacttgacttattaataaaagattgtagaactccttacttggagattgccagaatatgccatgtaagcggtggtactattcatgtaagaatgaagaaaatggaagatctaggaataataaaaggttctagaataattttaaaccttcctaagctaggatacgatgtatgttgttttgtaggtatatatgttgataaaacatcttcttttaactatgtatttgaccaaatgtcaaacataaaggaagtagttgaattgcatttaactactggtgattattctatgtttgctaaagttgtatgtgctaatattttagatttgcagaatgttttacttaataagataaataacattgatggagtacaaagaactgatacatttatttctctatctcaacctatagacagaaatatatcattagaataattataaaaaaatagaataaaaacacatttttatatacatactaaaggtatcttataataaggagtgtgttttttatgaaaattttaaattcaatttcacttgcccttataattataggcggcattaattggggcttaataggtttttttagatttaacttagtagatttcctttttggaagtttttcaatgttatctacaataatttattgtttagttggaattgctagtttatattctatctcttttttcgttcaagaaagatctagagtataatgctgcataataaatattaatattatatttgttaaaataaaaatgacttaaacgctaattctatagctgctaatctcaatataatatttatttatacttaagctttatacatagtgataagaaatttttaatgtaaaattaatatttctttagctatgttttgatatataatggaataaattattaatacttatattttactaggaggttagtatacatttgcgtacagtattaaattttaatttttataatttaatatatttttttgtattctattcatttgctggctggtgcctcgaagtcttgtattattttaaaaatgaacgtaggtttgttaatagaggatttttatatggtcccttttgtcctatatatggatttggtgtcttatttcttgtagtctttcttgataactacaaacataatattttcgccttattcttcttagcctgtttctttacaacagtcttagaatatattactggttttgtattagaaaaagcatttaagacaaaatggtgggattatactgacgatccatttaatatacatggtcgtgtttgtttactttattctctactctggggagttggtgaggtaggcataattaagataatacatcctatagtggtaaacataatcaataatattcccaaaacacttggtgaggtatttattttctttattattatttattatcttattgattttagtttaactatagcttctttaatgcaatttgaaaaaatgtcttttgcatttcaatttgtaccagctaattttttatttgataaaccaagttcattattgaattttacaaaagaaaaagctgttggtagaattagacactttgaatcattttttagtaagctaaaaatgaatttatataatagacaatcaagacaaaacttttcaagtatttcttatagatctttaaatatttttaaggctttaagagataaattaaaaagagattaaggtgaattctttaccttaatctcttttaggcacatgaaaataaataacaagtccaaagttgccatggatatttttcattatgcaaggcgacaaattgccctcatagcgggtctattaggtcaatttgccaacgtagcataatggtaaataggccggcaaatggacttgttatttatttgattatgccttagtatttatttcatgcctttaatttcatcgaataattctatagctgcatttcttggcccatttttttcttgcccttttacacctaaacaagttctaatttgtccaacttttacttgtccattttcaaacattgtattaaaatatttttctataagaatatttgtttcatcctgcttttgcgctggcccaaatggatttgcaaaaaatgactctactaagcccttctccgttgttgttcccttcgccattctagcacctgctttaaatactttaatggcttcctctggagttttaaagtaatctaaatatttttctccttcattaacgccgtcgtaattattagcatagaagaaaaagtctattggatgtccctttgatatttccttatatgatgctactggtactacaagtctagcgttgaccttatccggattcataaatatacttctatccatttctttaaaggcgtatccttgatctaagtcatctaatcgaacaaatgcaccaatctcagttccatatcccttaattaatccatcctctattttaaaagttcccatatcatcaaagataatagtcatatctgaaatataatcttcgcttaaactacgaaaagcttctaaactttcagatttacctgctccgctatctcccatgataacaacattagcttcatctccgctttttaaaataatattcaccattgaaccatgtattggcaaataccctctctttatcattattaagttgtataatgttaatgtcatcttctttatataaccaaaataatctatcttttctgaatgatttacatatccaagcattatatcattttgaacatcatcaaagaacactgtttttagatcttcatcgttatctttagctccaaacacataaataatatcaggctttcttccccttgtttcttcacttctagccatctcgaacagattacataaagttattccatgttccataaaatctctatggaaataaataaaagtaagtaacccgcctatcttagctggataacaaaaccaatgctctttatttatttgtgcatactttaatgggttatattttatctctgtgaacattccatctcttgtattctttttaggataagttataaatggtgtttctaaaagtatatgatcaataaatggtacttcctctaaagcttcatatccatttggtcttacccattccatttcatgaatcattatgcaggcatttccaccagctggtatttgtctataaacttttggctgatatcctgcaacatgctgttcaatttttctgtacaaacttagaattaatgtagaaaagttagcatttgcttctgtaaaactaactgctgcaaggccttgttgaaccttatatctatgaactattgtatatctttcaagctttctccaaaataaatagaaatcttctataaatactacaaacttgtccctatcctctaataatttcgaatatgagtcactaatctctataatttcctcaacactcataactgttaaatattttattactacagttaaatctcttctaatatctataagactatctgtatctaatgtcttacttaaatatctgtatgctactgaatttttctttttagcccttcttagataaacttctaaaattcgtctaaatccatcactttctagtatagcctcaaagctattacagtactttgctgtaaagtttatcatcactttgtcattactcatagaaaattctttcttcatttcatggccccccatatgaattttttcatatttaaatattgcatttttcatttcaaattccacatattgaaataattatatcatattttttgcaatattcaacctttgcatttttcattttaaagtttttttcatctaaaaatctctcaagttcataagaaatttcttaaattaaaattcagcaaagttaattcctccactcctatctgactatgctataaaaaagctcagaaagctcattatatgaatattatatcgcctttttacaattttgttcgtgttttattttaactttttatttttcttttgcttgcatttagaataattttgtttccattacatttccttaaatgttagaattatattaaaactatgtaatcaaggagacaacttttttatgaacaaaaataagtataatgtaaaaaaatatttattaacttttcttgcaattctattattttcattttccatagtaagttgtggccttacaaaattcaattcaaataaagccaataacgctgatacaaacaagatgttcgttcattatatagatgtaggccaaggtgattgcattctcgttcaagtaaataacaaaaatcttttaatagattctggacctaaatctgatagaagaaaacttttcaactatttatcagggctaaacttaaataaattagattatgtaattgcaactcatccacatgaagaccatattggtaatatggatgatataataaaaacttatagtataggaactttctattctccaaaagttgaatctactacaaaaagctttgaggacatggtagatgctttaaaagataaaaatttaaaggtacatgtattaaaaaacaatggtaattctattgacttaggtgaaaatactaaagtaaatgtcttctctcctaataaggatttttatgataatttaaacaactactctcctgtaataaaaattcaatatggtaacacttcttttttatttactggtgatgccgaaaaggaagtagaaaaagaaattcttaataataatgaagatatcagcgcagatgtgcttaaagtgggacatcacggatcctcaacttctactagtaaagactttctaaaaaaagttaatccttcaatagcagttatatctgtaggtaaagataatatatacaatcatcctgatgctattactacaaaattattagatgaaagcaatataaaaacttatagaacagataaagatggaaccatcgtcatctgctcagacggctctaacatatcaaaaaaataaatcaacacaaaaagggatgcttcattatattaaaagcatcctggctgttcttaaagcattaaaatagaccccaaaaacttggagtcatttaaaaatcagaaataaaatttatttatttctaaattatttatttctatcttatttattttgcagtcattaattagaattattattcaatgaattttcttgaatatcatactcttcttctagattttctaaatcttcaacttcatcttcagcgatagcttcttcgataatatcttcataaatatattttttccaatttacatatatataatataaatttataacatcctgctcattataaagaagaattttttcaattttctcttctggcattcttttgaaatagcttttatctttcataactttgtgaaaagttttagctaaattagatccgctgattacctctccctctcttacaatatcaaaaactttttctaactttttaagcccaatagacaattttttattcttttcatattctttttgaatatcaatcgaatcaaattcttcactaaaattataatatatattattttctttgaaaagataattaataactgaaaaatcattattccctgaaaaagtgataatggccttttttcctttttgtttcatctttataaaatattctttagcgagatacaatatatgtgtcgcctcatctctatcttcaatcatatattgggttactagaatattattatttttcttatcatactcacacgccccaaatactccaatacacttaggcttcttatatacataatgctctaaatcaaagaagataatttcttctggtgtatattctttatctagagacttcatcataaattcttcactatattcttcaaccttcaccttattttcacgaataatcacagtatcactcttttctataagaattgtatatcctcaatgtccaaattgtatattacatcctttctttcaacaacaacattcactctttttattaattctcgatctttcaatactttttgcaaaagttctttagttggattcatacaataaggatgttttacatttttaaacatagtataatcgcctgctgtatctccatatgcataactatcgtttaaatctatatcatactttttaacaaattcatttatcgccttcgatttacttttactatcccacattggtgtaacttgccctgtatatacatttttatcatctataatatattttgcacctatataatctgtaaagccatatttcttggccatctctccaacaagttctgaaggcgatccagatattataattagagtatggttattagcttgatgccactttattctgtccctcgtaaaagtatatactctatcacccttttgttctacaactttcttagctatatattccatttgatacttctgtaatcctttaattgattcaatatatatatcaatcattttcaacaggtattgatcataatcaccttgcctcttatcccacttcataaagtaaggccttagatcattataccatctttctgaacctataatttcatatttaaccatctttttaaatacttctgttattagtccttctctgtataaagttccatctaaatcaaaaaacgcacctatatttgccattaactcacatccttttatacttatttattatactttattttttcatttcagaaaagcttataaaatctatctgattaatttaaatatatatgttgcaattcacaatgcacatttcacgattcacaatcacgacggaaattcttgcaatattttttgaattatgataaagaattatttttgaaatatatcatataaattgtataagtaaaaacactaccaaatatatttattattgatagtgtcgttaaaatttatccatgactattctataaaagttagaatttcatctatattctttctcactttttttcttatattatcattttctggatatccaacagccactactaatctaattcgctttaatttatttatatttaaaagtttctttagttctttttcattaaaccaacctaaaatacaagtacctaaattttgttctgttgccgctaaacatatatgctcagttgcaatcccaatatcaacagatctataatcctgctgtttaattaatgctccagctcgtgaagttaaatttccactttcctccaccactattataaaagctggacattctgtagtaaatttattcataactgcatcctgtaagcattctgaaaccttaggcactagctctttattattaactactacaaaatgccatggttggctattacatgctgatggagctaatctggcagcctcaatacattttactaacttttctttttcaacaggtttatttaaatactttctacaactttgacgttcatttaataaatcaataaattccttcataaaacttctcctaaattctttataatcttttataaatcaatttctccaaggctttctttcttaactaatcccggattcttttttctaaactcctctactgttttctcataatatatttttatggttgccattgtaggtgatcctagaagcattccaaaaggtccccaaaagccaccgcctattgcaactcctaatattatccctaagggactgactccaaccttttttcctataagcttaggatcaaggtaccaagcatcaaaaagatgaatacaaagtaaaagtataaacaccataaaagccttcataggtgaaacaaatattgcaactcctgcaccgactacttcaccaatgagtggtccaaaataaggaatcatattagtaatcccttctatcagggctattagtggtgcatagggttccccaacaattaatagacctataagtgatatcaaacttattattgcggaatcaatcgcctttatacctatgtaaactcctatcattttattataggttctaataaatgtaactaacttgttccccttttcttcattaaaaatcatgtatgttatggttctagcacgttttagtaacttttctttatccaataaaacataaattgaaattaaaaaaccaaaaatcacactaactaaatttgatgtaaatgataataagtacataacaaaattttgtagtagtcctattgttacacttcctatctgacttgacatttcttgtagcttattcaaaagtcctgcttgtacaatcagtgtctttattctttcattttgaagaagagtattgatccatttttgtataatttccacataggccggcatttctttagttatatttactatactgtctactatacttggtatcgtaaaaaataatattataataattaaagctataattataaaatatgtaatcaatattgatattgctcttctagttttaaaattattctcaaaaaaactcactactggatttaatatataagcacaaataatagcatatataaaaggtgacataatagataaaacttttctgcctatatcaaagaaaaaattataattatctataagtttatatccaattacacctattaaagcaaatattaatatatccctatatttaatatttctatttataaacaattcattccacatcctttccatgcttttttcaattataccatatatcacttttttaaggcatataaaagaaattaacgagtcaaaaatatcatcaggcattctatatgcagtatctctacttttttaatatttatttcttacatcaggcaaagaaattaaaaatagagggttgttgcataaaacatccctctattccaaaaaaaattatactaaatttaatattaaataactacattttttctactacatctattccaagtaactctaatccattttttattacttgtaaacttgctttaactaagtttaatcttgtagcttttaaatcctcatcttctaagttcaatactgaatgcgcattatagaatttattaaatccttttgcaacttcaattacgtatcttgttaatattgaaggttctaacttatctaaggctaaagttattacgctattaaagttagctatactcttaactaactcaaattcttcttttgaagataatttactataatcaacagttccagtgcattctttacctctgtttaatatactatttcctctagcatatgaatattgaacatatgggccagtttctccatcaaatgataatatttctttccaatcaaaaacaatatctttttctcttgagtttttaaggtaagtaaaaattactgctcctacaccaatcttctttgcaacctcttctttattttcaagttctggatttttttcatttataacttccattgtcttctctacagcttcacgaagtaaatcatcaagtaaaacaatcgatccatttctagttgaaagttttctatctgcaaatttaactaacccaaagcctacatgaacacagtctttagcccattcatgtcctgcaagttctaacactttaaatacttgcttaaagtgaagtgcttgcggagttccaactacataaacacatttgtggaaatcataagttttctttctatacatagcagctgctaaatctcttgttgcatatattgatgcaccatcacctttaagtactatacaaggtggcatattatattcttcaagcattacaacttgagccccattactttctacaagaagtcctttttctttcaattcattaacaacaacatccattttatcattataaaatgcttctccagctaatgaatcaaatttaacgcctaaaatgttataaactctttcaaattcttttaaacttaaatctctaaatctagtccaaagagctgttgctttttcatcgccagtctctaacgctttaaagtttgctcttgcttcatcttctaatgaaggatccttttcagcctcttcgtggaatttaacatatattctaagtaattcatcaattggagccttttctaatgcctcttcgtctacccatctatcatacgcgcttataagcttaccaaattgagttccccaatctcctaagtgattcaatcctacagtattatagccttcctttttaaacatcttatataaagaattacctatagctgtagtgaataagtgaccaacatggaaaggctttgctatattaggtgaagaatattcaacgcaaactgttttcccttctcctatatttgatgctccataattttctccatcttctaaagcctttttgattgtattttctgcaaatactcctttatcaacgaagaagttaacatatggccctaaattctcaattctttcaaatccatcagttgacatagaattcttcaattcttctgctatcatatttggagcttttctcataacctttgacaattggaaacatggaaatgcataatctcccatttctggctttggcggtatttcaatcaatttttcaatagcttcaatttctaattccacatgtttttttattaattctgcaactttacttttataatccataatatcctccttatatttagacaaactcttcataaattaaataactttataatttgtaagaatgtatttctttattctttctcaaaatttaattttcttagtcagtatttctcataataaatgcataaatttaacttcgatatagattcctaaagaacaaaaaaaatccgcctcttaaataaaaagagacgaattatccgcggtaccactcttattgtattttatataaataaaatacctctcaacttttaacgcaatttaacttgcgaccagccctactaaaggtttaaaaataataattaatatatcataccagctatattagattattatctttttaactacttatttcaggtgatttctccaaggctcttttcacttaatctatccatagggcttacaccatctccctattcgctaaaggaattaattaaattactttcctcttcttagaatttttcaatattaatgataataaattatacaaattatcttaaattttgtcaactttatttttaaaataggaaacgtgttattaaattagtaatccctaaaagcatattacgtataacgccggctggtatagaaattattcttcctccaacaaagattaacgctaacataatgaacatttgatattgataaaatttttcttcaaatctatagaacgtatttggacttaaatctcttaaaagactaaagccatctagtcctggtattggtatcaaattaaataatcctatatttacattaataacaagcgtcatatatatcattcgctctaaaacaccagctaatgcatctggtaaaaatctatatgcaaaactataataaagtcccaaaactattgaagttgctatggcaactaaaaaatttgcaattggtccagctaaacttactttcaagtcatctttataatagtttttatatgccgatggattagtttgtactggctttgcccatccaaagctaaagataagtacagccacaaatcctataggatcaatatgcgcaattggatttaaagtcaatcttccttgaaaccttggtgtcttatctcccattctatctgctattaatgcatgtgcatattcatgaaatgtaaaagcgataagcatccctggaatcattaaaatcatattaagtactgaattcatgttttcctcctttttcgatatgtatgttttatattatatcatacttagaacaaatcctattaaaagaacatatatatttcaactaaataatattactctgttcttatagacttattcatttttgccacctaataatttaagataaatttttataaattaaactttttaggtatatatattttttatcttccttaggctattatagtgtcttaaatgtttatataaaatgtatatattgcttactatttattcccaacattatatcataaaagattactatcaacaatgtaaatgcacttattagtttatatcagaacattgttctatatgttgtactaataaacctacatttaaaattttagtaaaacaaatgctcaattaagacaaaaggtagaaactcagttacaacatatacattataagatctaatttaataaagagtgtttaatttcaatttaattaaacactctttatttaccatctttatttactattatttaaacttttataaactaattttccgctattatcttcagtcgctatgaaatcttctttaatctgaacaagttttccttcatattcaacttcttttcctgtacttaaattcttaacactacctttaagattatcattgactagtatttcacttttattactaaaatacaagtcattagcacttacaaccgaatcaagtgttgcctttttccaatttgctgtatcttcatcaacttttccataagtgatactggtaattttatcaccgttaagctcaccaatataaatcacatcatttctgtcgattccaagaagcgtcagatttttattaccactaaatgttaattgcttattagggctcgtaacaaaaaatttactattcaacttatcttcatatattaatctatcgttgtgaggcattactttcatatttcctaaaacattaactgctagaggaaccttttttctttcataatctctatcaaatctataaactgtgctctttaaaccacctgtatatatttctacataaaatacacctgtaaagacagaagtggttatcttcttaacttccataccctcttggtatgtgcaaatatcttctttacttgcaactgtttctgttaaatctttagcattatatgttataagctgaactttagattctccatctttttcaatcttctgagctattactagtatatctctttctaaaagccaatcataatacataattgtgccctttttttctgttgtaattggattgcttgtgcccgtcttggtgtcttccaaatacacactttcgccatcctgataacatatgtatttaccgtcatctgatattttagtatcttttgcattacccgggatagatgctgaaatatcttttgtattatcctttttttgaacttctattttattacttttaaattctgacgtatgtttaaaaataaaattttctaaaatatataagccagaaatttgtaatagtatagataacaatgcccacgcagttatcttcttaaacatcttcataattctacctcaccttctgtttatttaacaataactgctgttggaatagttctttctcccatactatttgatggtttatttctaacttctccatagtaatacaatgttgtcgattttccaccatctaaattcattgcattccatgcacctagctgatgcataatctcttgtaattcctttaatgttgctcctatacttccaatttctctaccatctataactaggagaattattgagccatccttcatttgtcctatagcagttttaggggctgtcccaaatcctccatcaccgtttatctttaccatatttccattaattattaatgccggaccaaaacttaaagcttcctgaattccaagttctttaagtttttctactgtataatcacctacaaccattactccatttttatctatcccaaaggttgttgttgggttatctcctacatcattaactttcacttcaccaccagtcattacaatccctgatgccaatccaccatttcctgtccattgagcggcagatgattgatctgtaaatgctccaccattaatggcagctatagcatcattgttttcagcaattgttgatgtagtttcaccttcaactcccaatttagaacttactccaattttaactcttgttgggtcttttaccaccaaataataaccattatacttagaattttctatatcatgaagttctatagtatcatctttaacctttggaactttaatatcagatatattggtagtttcactagtttcctcagttgagttttctcccataatttcagctatttttttatctgataagaaccatgtagccagatattgatgactcattgaagtcattgctgctccaacatattggcttttcgcattatcaaatggtccatataaaagtaaaaatgggaatgtacatccagtaaaaaataattcaaatgcaaaaaatatagctaatgtcttaaatgaaatcttatttactcttttcttgcttttttttaccttagatttcttatttatattcttattttttctatttatatccattttattatcctctctaaaaatgcattttagttgcatttataaaaattacaccagacctaattatataatattttcaattagattacaataatttcatttttccagcattttattctatttggtacttggattttgcttttaaatactcacattatgttataattagtcttaggaggtatatataaatggaagataaaattttaaatgaattaaaaaaatctcaagattatgtttctggcgaatacctaagttctactttaaatgtttcacgaactgctatatggaaacatataaaaaacttaaaattaaaaggctatataatagaaggaatttctaataagggatacaaattacttaattctcctgatttattaaataaaaatgaaattctacctttattaaaaacatctgctattggaaaaagcatagtttactttgataaaatagattctacaaatattaaagcaaaagagcttgcacagaaagaaatcgaacacggtactatagtaattgcagaaaagcaaactttaggaagtggtcgcttcaataggaaatgggtttctccaaatggcggtctttggttttcattaatattaagacctaaacttcctccaacggaagctcctaaaataactcaaattgctgctgcttctgtatataagacactaagtaatttaggtattaattcaaccattaaatggcctaatgatatacttttgaatgacaaaaagttttgtggaatcctagctgaaatgaaatgtgacatggatagtgttcattatctagttttgggagtagggatgaatattaatatagatgaaagtgactttgatgataatataaaagcaattgccacttcactaaagattgaatatgataaagatttcaaaagaagtgagatactttcagctttcttaaataatttcgaagtattatacaataacttcataaataaattagatctttccgagacaatctcaatctgccgaaatcattccaacattttaggtcgaaaggcaaaattaatcacatataataatgaagaaattgttacctgtgtttctgtttctgataacggcgaccttatggtcatagatagcaacggaaatgaaaaagctgtaattactggagagattagttttaatggaatgaactaaaaaacagtattgcgaaacactcaaaatgatgagataagcaatcgaaagagaatacatatatgttccacatgactagaaaaatttcgttggatatatctaaatagaaagttccaccatttcttcatgctcctgcgacaagcgcgcaggacaagcaaaaatggaacaacttcccattaagatataagcaacttatttttcaatgcctgcttcacatatatgtattctctttctttgttttgccatcattttgagtatttcaaatattataaatttatgatgatagttataagaaaaagtcacagacgaatgtgtagtggtatcttttaccagctactttttcaaatatatgtgagaaaaacttaggaatcaatatagactctaaaatatttaagtcaattattagatggatattgctaaatgcagaaatataaaaatacttccataaatatgaatttgatttaggtttactactaaataaagaaagagaatatctgcttttgtgcagtgttcattagaagatcttgctggctgtgcttcttagattagaagttgttccaaatatgctagttcaaaacttgcttttgaggctagcattttgggcacaacttctattcttagaatcacccggcaaaatcttcagagaaccagaacaaacgcatatattctctttcgagagttcagcagtaaacttagaccctactcatactgcaagtatttttatattttgtttagtacacaatacatttagttaattctagttatttattaacaactttttcaatgtgtccttttagaacagttgctgattcttttaattttttcaattcttcatcatttagaacggggtttacaattctcacaacacccttactatttaaaattgttgggactgctaagtaaacattttctatcccatactctccctgcatcaaacatgatacagttaaaatagtattttcgtctcttaatatagcttctactattgtatttactgctaatgctacagcaaaataagtagcatttttcctacttattatttcataagctgcatttttaacatcgctttctattactgattttacatcatcatcccactctaaattgaactttttagcatattcttcaaaagtttctccagctatacttgcagtactccagctaacaacttcgctatcgccatgttctcctaaaacatatgcatggatattattattatttacattaaagtatttaccaataacgtattttaatctcgacgtatctaatacagttcctgatgctattactctttccctagggaatccagataacttgtaagttatatatgcaagcacatcacatggatttgatactactaacaaaatagcatctgggcttgctgctgctatttgtggaacaaagctcttaaatatattgtaatttttttcaataagatctagtctagtttccccttctttttgagctgcaccagctgtaattataactatatctgaatctctagtttcttcaatacttcctgcataaatgctaacaggctttacaaaagaagtaccatgaactaaatccataacttctcccattgctttatccatatttatatcaaataaacatatttctgtagctactccactattcattaatgcatatgctgttgttgcacctacaaaacctgcaccaatcacagatattttacgttttctttctaccattatatattcctcctaatttatacaatattaattctattctttccagataacaaatttattatttgctcataacaactttcatcttataattattatgaatttattatccaacaattttattaattaataatcattcttatctgattataccttatttgaattttttcgtaaatactatataattaaatttagcaacttaataatgaatttattagtaagcatatagacgtaattatttttaaatgttttacgcagaagatggaggtacactttaatgaaattattattttttgatacagaaaccactagtataaaacccggcagcatatgtcagttaagttacataactgttgatgctagtacaaaacctcagataactactggtaaaaacttcttttttacagtcgatgagatggacccttctgccaaagaaattcatggtttttctttagagaagctttatgaattatctgatgggcaatattttgaggatttagtacctgaatttcttgaggattttatgactgctgattttctaatcggtcataatgttaattttgatgttagatttttaaaacatgaactattatctttaggagaggatttttaccccaaaaatgttttctgcactatggcttactatagagatatatgtaagattccaaaagccaatggagaaatcaaaaatccaaaattatcagaagtgatagattggttaaatatatcaagcaatcaaattgttgagacatctgaaaaattatttgaaggtagtggaaattaccatgatgccagatttgatacagctgcaacatatttaactgttatcgaaggattaaagaaaggccactttccaaaagggtatttttcaaatcttctagctaggaactcaaacggtttaaaataaaatataatttttattaattaacacctcaataaaaatatcatataatatactataacttgtggtttttactctatctattctttatggtatctagaattttagatttagacagttttaaaatttattcttgtcttgtttaatttataaatgaggtgataaaatgaaaaaatatgtttgtgaagtatgcggatatatttatgatccagaacttggagatcctgatggtggaattgctccacatgtagattttaatgatttgcctgattattgggtatgtcccatttgcgcttttaacaaagataatttttctgtactagaataacacattataaaaattatatttaactcatctcgtaaaaattagtatacttaaagacaatttaaattaatattttcatatgaaatcaaaaagactatatggactggaatattatgtcctatagtctttctatatttgtaattaatttattatcttcaagccatttatattttcttaaaattttagtacattcaaattcctcaaaaactttactataaacagaataattttattttactaaatactttcatggaatgttctgcttataacttctaactgttgttcttttgataatctgctaaagttaaccgcatatcctgatactctgattgtaagtgttggatacttatctggattttccattgcatctattaatgtttgtctattaagaacattaacatttaagtgatgagccccttgagtaaaatatccatctaatattgcaactaggttagttatcttttgatcttcattttttccaagtgcatctggaactattgagaatgtattagatacaccatcttggcaaatttcattatatggtattttagctactgagttaagtgatgctaatgctccattaatatctcttccatgcattgggtttgctcctggcgctaatggttcacctttctttcttccatccggtgttgttcctgttttcttaccatacattacatttgatgtgattgttagcgctgataatgtatgttttgcatctctgtatagtggatgcttcttaagctctccagagaatttagttactaattctactcctaaatcatctgctctgtcatcatcatttccgtatttagggaaatctccttcaacttcaaaatctatagttataccttcttcatttctaattggtctaacttttgcatattttatagctgacaatgaatctatagctactgaaagacctgcaataccaaacgccattaatctttctactgctgtatcatgaagagccatttgacttgcttcataagcatatttatcatgcataaagtgaattatgttcattgtatccacatacacttttgctacatattctaatactttgaagtaatttgcctttactttatcaaaattaagaatttcttcgtctgtaaacttttcaattcctggtactaccttaataccttttaactcatctactccaccatttatagcatataaaagcgatttagctatatttgctctagctccaaagaattgcatttgtttaccaaccttcatagctgatacgcagcaagctattgcataatcatcaccataaaccggtctcataacttcatcattttcatattgaatagagtctgtttttattgagatttctgcacaatatttcttaaagctttctggaagcttatctgaccataaaactgttaagtttggttctgctgatgttcctaaatttattaaagtatgaagatatctaaatgaattcttagttacaagcggcttaccattaatacctacaccaccaattgattcagttacccaagttgggtccccaccaaataattcattatattctggagttcttaagtgtctaactaatcttaactttataattagttggtcaacaatttcttgggcttctttttctgtaattaatcctgcttctaaatctctttcaatatatatatctaagaaggttgaagttcttccaaatgatgttgcagctccattgttttccttaattcctgctaagtatccaaagtataaatgttgtgctgcttcttttgcatttgatgctggcttagatatatcaattccatattttgctgccattgattttacttcacctaaagctctaatctgcattgaaacttcttctctttttcttactaactcatcaagcatatcaccgtttagattatcaagatcctttttcttttcttctattaagtaatctataccataaagagctactcttctataatcacctattattcttcctctaccgtatgcatctggtaggcctgttaataatccagcacttctcgctgctcttatttcttttgtatacgcatcaaaaacaccttcgttgtgagtctttctgtattttgaaaaattcttattaatttccggatcaagttcatatccatattcctttaatgaactttgaaccattctcattccaccaaatggatttactattctcttaagtggtgcatctgtttgaagcccaactataacttcgttatctctatctatatacccaggatcataattatctatccctgatactctatctgtagcaacatcaattattcccttttttacttcctcaactattaaggcataagctttgccccagactttgcttgtcctttctgttttctcttctaagaaacttccatcaccctcgtataatttataatttttttgtataaagtttcttacatcaatatcctcttgccatgttccgtttttgaatccttcccattgtttaaacataatttttcctccctaaaataatttaattatataattttttccatataaaaaagccgacgcaatccaggctttttttgcccagacggtcggctttttgtggcatataagataatatgcctagtcatacttcatgtggtaactccacttccgtcagtcatatgactaatatctaatataagaataataccaaaccatttagtttgtcaataagaataattttacacttattagtattaggcataatgaagaaataacgagcccatctgtaaaacatattttccattttgcttcatcagcagatttcactaataggctcgctataaacccactctgcttatttgcctactaaaaaataatcatagcattttggacttgttattttatttcatatgccttaagttaatcttaatgctaaatttaaaattcccattgaacccatcttatttgccataagaataatctccaaatatctctttctggtattttttaattaattctttatccatagcttttacattttcaagaggatatttaatccctagtccttcatacttatttgtacctaataaatgatatggaagtaattctactttctcaacattaggtatctcgtcaatgtattttttaagttcctttaaatgttctacatcatctgttaatcctggaaccacaacatgccttatccacatctttgtattatttctcttcatcgcttctaagaatttcaaggattcatctatattcattaaagttatatttttgtatccttctggtgtaaaatgttttatatcaaataaaactaaatctgtatattttaatatttcatcataatcaccaaatccataacctgctgtatcaatacaagtattaattcctttacttttgcatagtttaagagtttctagtagaaattctggctgccttaaaggctctccacctgagaatgtgactcctcctccactacttgcaaaataagttttaaatctttcaatcttattaactagctgttctggagtatattcctctccaccattagtagcccaagtatcaggattatgacaatacttacatcttaacgcacaaccttgcaaaaacactactactctaattcctggtccgtccacaagacccatgctctctattgaatgaacattaccttttaccatttgttacaccccctatactttattatacttcaaattaatatacataagttctaaataatataattcatcctctataaaattatttggggacattatctagtattttaagagaacgcttattgaattaacacttttagaatatatattaatttattattcccttaaataagctattaatatttaagccaattgtatatggtacactatatcattacttaatattatctaactctattgtttcttcatcataaggcaaaagaagggaaagttcaccttccccttcctccaaaatttttttattttatagtaatccttaaataatatacattattctacttctcattagatgctctcatggaatgttctgcttataacttctaattgttgttcttttgataatctactgaagttaacagcataccctgaaactcttattgtaagtgttgggtatttatctggattttccatagcatctatcaatgtttgtctattaagaacattaacatttaagtgatgagctccttgagtgaaatatccatctaatattgcaactaggttagttatcttttgattctcatcttttccaagtgcatctggaactattgagaatgtattagatactccatcttgacaaatttcattatatggtattttagctactgagttaagtgatgctaatgctccattaatatctcttccatgcattggatttgctcccggagcaagtggttcgcctttctttctaccatctggagttgtccctgttttcttaccatacattacatttgatgtgattgttagcgctgataatgtatgttttgcatctctgtatagtggatgtttcttaagctcatttgagaatttagttactaattctacgcctagatcatctgctctgtcatcatcatttccgtatttagggaaatctccttcaacttcaaaatctacagttataccttcttcatttctaattggtttaacttttgcatattttacagccgataatgaatctattgctactgaaagtcctgcaataccaaatgccattaatctttctactgctgtatcatgtagtgccatttggcctgcttcataagcatatttatcatgcataaagtgaattatgttcattgtatctacataaacttttgctacatattctaatactttgaagtaatttgactttactttattaaaatcaagaatttcttcgtctgtaagtttttcaattcctggtactactttaataccttttaattcatcgactccaccatttatagcatataaaagcgatttagctatatttgctctagctccaaagaattgcatttgtttaccaaccttcatagctgatacgcagcaagctattgcataatcatcaccataaaccggtctcataacttcatcattttcatattgaatagagtctgtttttattgagatttctgcacaatatttcttaaagctttctggaagcttatctgaccataaaactgttaagtttggttctgctgatgttcctaaatttattaaagtatgaagatatctaaatgaattcttagttacaagcggcttaccattaatacctacaccaccaattgattcagttacccaagttggatccccaccaaataattcattatattctggagtccttaagtgtctaactaatcttaactttataattagttggtcaacaatttcttgagcttctttttctgtaattaatcctgcttctagatctctttcaatataaatatctaagaaggttgaagttcttccaaatgatgttgcagctccattgttttccttaattcctgctaagtatccaaaatataagtgttgtgctgcttctcttgcatttgatgctggcttagatatatcaattccatattttgatgccattgattttacttcgcctaaagctctgatctgcattgaaacttcttctctttttcttactaactcatcaagcatatcaccatttagattatcaagatcccttttcttttcttctattaggtaatctataccataaagagctactcttctataatcgccaattattcttcctctaccataagcatcgggaagacctgttaataatcccgcacttcttgctgctcttatttcttttgtatacgcatcaaatacaccttcgttgtgagtctttctgtacttaggaaaatattcttcgatatttttatctaactcatatccatattcttttaaagagctttgaaccattctcattccaccaaatggatttactattctcttaagtggtgcatctgtttgaagcccaactataacttcgttatctttatctatatatccaggttcatagttatctattcctgatactctatcattcgctacatctataattccttttttaacttcttctactattaattcataagctctcgcccatactttacttgttttttcagttttatcttctaggaaagttgaatctccttcatataacttataatttttttgtataaagtttcttacgtcaatactctcttgccatgttccgtttttaaatccatcccattgtttaaacattagttttcctcctttatacttttgattaaaaactttgttaatttttaatcaattaattcataccattattgtatactttaattaaatgcatgtcaatgatatcttttatcagttagtaattagtttcacttttttgttaataaatctatcagactttcataagataatatttctataagttcgcgaaataaattttccccttaacttgtcacttattgctaattaagatattatctttaatttataaaaaatattattaataaataaatcaataacttgatttatttatctctagattactaactgcaaatattataacctttaccatttcttaaatttataatatttttctttcagtgtataaattaatttatattgacatattagtattatcagaaaacgttttaaacataatgttatttacatttataatttttaaatattcttcaatcttttaaaatccatttttgaatttcatattttagattcataagtttataaaactataccaaaaagttttctttgtcaactttttttagaatttataacataaatttaacatttgtacaaaataattgacacaaaataatgatataattttgttacaatattgtttatacataattcaaaggggagaaaacatatgcaaaggaatgctaaactatctttattttcttttttagcaatagctctatctgtctttatattatatcaagttctttcttattttaatttttttagaaagaatctaactattattaataaaacattatactcaagtatgctaccagaggaaaaatttaaaagtacatatacacccaaaatcaaattttcggacaagcctgtaacaaaagtaaatgatgtaaccctaaatattttgaatacaggaaatctaactaatgttccaatactgctaaaagcccaaaggtattatatacctctaacttttatttgcagtaaactcaattatactttagatacttctaataattccatatcaatatataatgatagtaataaaattttcttaaatgaaaccacttatgaaaagaattctagaaaaggtaatcttcgtggtaatttacttaacaataatggtagctattatatttcaatttcagatatagaagaaatttttgatttatttgctgtatttgactttcagaacaaaaaaataaacctaatacctaacgatgtaaaggaaccagaagattcagctatactatatagcgataaaattggtttaatacgttttgaagattttggttgcggttatacaaatgttgtagataaaaatcaaacaaaaataaagataatggctaatttgctattttcccaaggactgaaatttcatatttcatggatacctagatttgtagttccttcagcaaattttgataatgatttgttgacgaatgataacattgtaaatgtaggatttgtagatgtattagattatgctcttaataaaggtggagaaataggtttacacggatatactcatcaatctggtaatgactcaagcggaactggtgaagaaatgtctaaagacgtaaatagtacagaagctgagactagagcagtaatagaaaaaggtatagatactgcaagtgctctgaacattcctatctcgtattacgaaagtcctcattacagagatactgagcaacaaaagaaaataattagtgaatattttcagttcatatacgagccatatgattatacaaaaagtaacatttataagccagatgactctcacttatttgttccaactccattaggccgtatagctgatccatcaacagatacgactcgtatggtaaatacgattaatgaaggagatgctgatacgcttaatagcttttattatcatccatctatagaaatagattatataaactttaacctaaatggaaacaaacttaacgtgaattatgatgcacgttcacctttgcaacaaatagtaaaagcatttaaagataatgattatactaccgttcatattgatgaacttataaacaagtaataaggaaggcttgccattcacatgacaagcctttatttttcaaatattttcgtaacatcacttaatattgcaaaatcagtaaaatcaaaatgaagcggtgttaatgtaacatatccttgatatagataatataaatcactttcttcttcctttatagcatttcttgttccttttgttgtatacaagtcaccttcttcattactttctaaaagtatatattctgttttatatgtggaccttccaatcttacagactttgatgccctttatatctctttcattaaaatttggaatgttaagatttaataccacatcactttttaaatattcttcctttgctatatctaaaacttttatcgcccatttaacagccttagaataatcctcatcatctttcccatattcaacatccattgaaactgcaattgacggaattccgtatatggttccttctattgctgccgataccgtacctgagtataaaatatcagtccctacattaggtcctttatttatgccagatattacaagctctatattctctttcaaaaaggataacccaacttgagtacaatcagcaggcgttcctgaaacactataagccttacaatctaagccttcaatgaattcttctttaattttaatcggactatgaatagatattgaatgactagacgcacttttttgatccttgggcgcaacaattgtaaccttatgctccttagaaatttcctttgctaaagcaattattcctggtgcatttattccatcgtcgttagtaattaaaatattcataaaccctccttgtaaatgtatttgatcacaacttaatgtaacgcaatgaataaccgaaatataaaaacacttgcagtcttatgaacatttaaatttcctgctaaacaaccgaaatggaatatatgtgtttgctccggttctctgaagattttactgggtaattcaaacaatataagttgcacccaaagtgcttgcttcaaaggctacgctttgaactagcacatttggaacaacttatattctaagaattacttccagcaaaatcttcttatgaacactcctcaaaaacatatatttcatttctttgtttatcttaaatttaaagtaaagcatatttaggcaagtatttttatatttctgttgttacaatacctttattttaactatattgtaactttttataaaatatatattctctttttctatattaagtgttactaaaagaactaaagtgataataaaacaaagaaagagaatacatatatgcggaacaggcattgaaaaataagctgctgcatatattaacgggaagttgttccaagtctgcttgtcatgggcttgtcgcaggagcatgcagacttgggtgcaacttcgcgtttagatatgctaagcgaaatttttcacagtcctgagaaacatatatgtattctctttcggttgttcattgcttcacgttgagttgttcttaatacttttattttgcaccatattgtttgtaatattcgtcaattctacctttaacttcgtctgttataagtatagttccgttaatctctttattgtataaatattctataacttccgccattgtaactatggcacaagttttaaatccgaatttttctctgatttcagttaaggctgattgttcaccttgccctctttccattctatctaccgatattataagacctttaacattaacatctgcttggctttttaagataggcatagtttcgtaaattgatgttcctgctgttgtaacatcttcaactattagtactttatctccatcatttagtttacttcctaaaagaattcctgtatctccatgatcttttacttcttttctatttgaacaatatcttacatcaatatcaaatgagctagacaaagcaatagatgttgtaacgcttagaggaattcctttgtatgcaggcccaaataatacatcataatcatctgcaaagttttcttttattgcctctgcataaaattctccaagtcttcttaactggcttcctgtttgatagttacctgtattaacaaagaacggagtctttcttccactcttagtaacaaaatctccaaatgtaagtactccacattctatcataaaattgataaattctttcttatatgccttcatttaaaattcctccaatatctactttgtaattattaatattcacttatcagttgcttattttcattattaggaattaggatctatgatcaatttatattattcctataatctcgttaatatccttaattccttgttccttcaaaaaactttccatttcttcaactatttctttcccagccataggatttacaaaattaatcgttcctatctgtactgcgctagctcctgccatcataaattctacggcatctttaccacttgatattcctccaagtcctattactggaatatctacagccttagccacttcataaaccattctaagagcaattggttttacagccggccctgaaagacctgcagttatattattaaataccggccttcttttatatacatctatagccatcccttttaaggtatttattaatgatatagagtccgctcctgcttcctggcactttacagccatatctactatatcttctgcattaggagataatttaaccatcaacggcttcttagtcatggctttaatttctctaaccacatcatatgctacttttgacttaatcccaaaagccataccaccatgttttacatttgggcaagaaatattaagttcaatcatgtcaacattactgctatcaattttacttacagcagcttcatagtcttccaagcatcctcccccaatatttgctataacattagttccgtactttctcattttcgcaagctcattttctataaatgcatctattcctggattttgtaatcctactgaattcatcattcctgatggtgtttcatatactcttatcccttcattaccttgcttggggtttattgtaagcccttttgaagatattccgccaagaattccaacatcataaaaattattaaattcctcaccaaaaccaaaggttcccgatgctgctattacaggatttttaaattctacattattaatagttactttcatcatattcttcttctcctttggttattataattcaacatagtatccatcaaatattggaccatctttacacgttctcttatgtccatcttttgttttacaagtacatactaaacatgcacccactccacatgccatatgcttttccatagatacatatacagcaacattcttttctttacacatatctacaacttttttcatcataatttctggtccgcagcataacactgtatcgtaatcttctggttttaaaatttcagtaacaaatcctttatgaccattctttccagtgtttgtagatatataaacttcatttacatattcttttaactcatctattaagtaaacatcatgtctgaatcctgcatagagatctatcttttgatctggatttttctttcttaatttctttgctagttcaagcattggtgctgttccaattccccctgaaactagtgctaccttgttatattctttctctaaatcaaacccatttccaagaggccctgttaagcttatttcatcatcttctttaagcttagtaaattctttagttccgtttcctactacagcatataaaaatgttagtttattcttagatttttcgcatatacttattggccttggcagaaatgttgcaccatttagctttaacatataaaattgtcctgcctttatttctgcatcatcttcaactactaatttatatatatcttttgagatctctttatttgaaactacttttgcatttctgtaagttatagccataaccctgcctccttaagttatctttaatgtaaaatttatatgttcttcactgcttctcttattgcatctctcatctttatggcttcttctctagcacataaagcaaactctttttctctattttcttttttgtaagcaaggagtattcctcttgaagaatttacaaccccaccatttccattgtttaaatatagtgcaacatcttcagctttcccgccttgtgcaccatatccaggtattaagaaaaacatattgctatagtttgatcttattttctttccttcttcaacatgagtacatcctataacaccgccaattgctgtatatccacaacttccagtataattttttcccatttcagtaattttatctgctacaacttcgtaaactttcttatctccagtagtatctagatactcaatatcttctgcacctggatttgaagttctaactaagctaaacacacctttacttcccttttctaaataaggtagatatggttcaatactatccattcccatatatggactaagtgttataaaatcagcttcaaaatccccatcaaaatgagcctttgcatacatggttgctgtagctgctatatctcctcttttaatatccgctatgataatttcacctttatctcttaaatagtctagagttttcttgtaagcaattaatccttcaagtcctaaagcttcatagtaagcaatctgcaccttaaagcatgctgatacatcccaagtcgcatctattatttgtttattgaattcaaagatagcttcactgtcagttctaccttcttttatatgatctggaatatagcttaatgcagtatccaaccctacacaaactactcctctttcttcaaccctattgtataatttatcaattatgtaatttgtcatttcagatctccctccaaccctatttagtccacagtcagaattcacaattaattcctttaggaactcatatcttataattttcttaattatgttctccattttctacttatgatattatttaagccactcttattttacacgtgtccgcttcctaatttataatcatagttgcgcctaaaaattctctatctagctatacgcttttttgatatgaaatgttcttaattcacccaaaaattctttattacgattctctcatatttcatatgtgtgtgcttttttaatacgaaatgttctcttttgtgctgcactctttttctaatgtgaactgttcttaattgcgcttcgcgctttttctaacgtgaaatgttttttgtcgcgcttcgcgcctttttctaatgtgaaatgttccctattgcgcttcgcgcacatttcatatgtgtatacttaatttctccaccctttattgtcataagaatttcaccgtagaattccatacctgtaaatggcgtattccgtccctttgatgcaaattcttctggattcacttttaggcatttattaatatcaactaaaactaaatccccttcgactccgatgctaatttttcctttattcattcctaggagctttgcaggattatatgacataagctcacttaatttatttagtgaaacattgttctctttcactaatttcgtataacatattgaaaatgcggtctctattccaaccattccaggcgaacctttcatcttctcatccgctgtatgtggagcatgatccgttcctattgtatcaaccatacccaattttatggcatttattattgcctctacatcctctttttctctaattggaggatttactctataatcatttatatctcttgttagaccaatatgatgaggagtaacctctagtgttatatttgcgccactcacttttccatcaattatacattttatagcttcctttgtgctgacatggcacatgtgtaatctagctttacttagtttagctaattctacatctcttattgtcatcatattctcagctatcctcatatctactttggagaattcaggactttcagcatgagacattataacccagttattcttcttcgcaacttccatggcttcaagcattgtattggagtttgatatcccaactccatcatctgaaattgctttaatttccttatcacctaaaagctcttctaaatgagttaatgtcactccatcaaaatcctttgttactgataaacattgatgaatatctattaaattaatttctttagatttatttcttacgtattctagaaccttttttgatgaacatatagggtttgtatttgccataagacaaactcctgtgtaaccaccttttagcgctgctctagatcctgtttcaatatcttctttccatgtaagacctggatctctaaaatgtgcatgtgtatctataaatgatggcattaaaatctttccttcacactcaatagtttctacatctatcttaaagatcttttgccctatttcttcaattattccgtccttaatatagatgtcgcctataaaatcttgggttacatctactatcctcgcgtttttaattaacagttccatataacacctcttaattcttctaaatttctgaaagctttgttatctcatcgcaatattcacatctatatcttccattctctttatctactaaaataaaagaatgaggtacatattcttcctggctagttatgcagcttggattcttacacttaattatattttccactttatcaggtagcgttggcgtaactttatttattatcatttcatctttcacttcacaaattgttattgtaggtgagagtaatcctaaaacagtatagtcaagttcaaagcagttttctatcttaattatatctttctttccaagcttcttactatccgcattaattatcaaagcaacactgcaatcattagtgtctagttttaagtacttaaatatcttaactcccactcctgcttggatatggtcaattactattccattcttaatacttgttatttcaagcatcttacatcacccccaaaagcttaatcattaacgccattcttacatacattccgtattcagcttgcttaaagtatgaagctcttctatcttcatctacctcataagcaatttcatttactcttggcagcgggtgcattactatcatatcgtctttagccagatccattttcgctctgtctaatatataactatctcttaatcttaaatactcttcttcattaaagaatctttccttttgaactcttgtcatatataagatatcaagactttcaattacatcttctaatttttctacctctatatattcaatgtgatttttcgctaaaacttcttctcttatatattgtggtatagcaagttcttttggagatattaatacaaacttattattttggtatctggacattgcttttattaacgaatgtacagttcttccaaattttaaatcaccacaaattccgattctatgattgtttaacccattttttaagcttgtaatcgtaagtaaatctgctagggtttgagttggatgttgatgtccaccatcaccagcattaattattggaacgttagaatagatacttgcaacttttgctgcaccttcttttggatgtctcattgttattatatctgaatatattgataccattttaattgtatcagctaaagtttctcctttagaaattgatgttgaattcggctctgaaaatccgagaattttaccaccaagtctcatcattgcagcttcaaagctcaatcttgttctcgtacttggttcataaaataatgtagctaaaattttcccgtcacaaatatgagaaaattcctttggatgtgcgattatttgatgtgctaaattgaatatttcatctaattcctctaccgtaaaatccataggctctattagatgtttaatatcttttatcattttattatcactccttcttaacctctctgtgttaatttaaagggaaaaattatataatactatataataaaaaaccttccttaaaataaaggaaggcataataatcctagatcattggtattatataacttccttattgatctctctgaatcaaattaaaggttattctttgtgtaagaataccatttctttgaggttgtgtcaataaaaattattttatataaatttcagataaattagtttaaattttaattaggttataaaaataactcctagttttctaggagttattaactatgtctctaaaagttgttcattatgttatcccacatcatttttccacatttagcaagggtaactgttccgtaaacactattaggaattcccattgaaagaacagtaaatgtaaaagatccttttggtgagtggatcaaagctgtatcgttttcaacgctagccttatcgcctgtcttgcttgatatttcatattttaaatcatcaggtatataaagtgctaatttgtttttcatttgttgtctttgtaatatatccataagcattttgctatttttctcatctaaaaagcttgaattatataagtgtttccatatctttgatagatctaaagcgcttgttatattttcaattccattacttacagctctttcatctgaagtttttctatttaatttagtatttttcaatccttgtgcttctatatcgtcatttatcttatctataccaactatatctatgagcttatttgctgccgtattatcactttgtataagcattgcaactaacaattcaaatatagtatattctctattatcaaattcatggagtattcctgttccataaactttatcttcttcttcaatttttattttatctaaaaatgtactgttcccttcttgaacatgctttattatagatactgctatcggcaatttcatacaccctgcacttgtcatttgaacattttcattgtatccataactaaaaccactttctaaatcctcaaagaaaaatgaatatgttcctattctagactctaaatatctttttatttctttcataatacccaccgctttctaaaaatactactaaatgtcattaggtatcttatgagtactaaatcactagtataatttggtactcatattaagttaactaatcggcaaatgatatccctattctcttagctacagctactaactctccatcttgatctactttcttgttattaccaatgacattttctaaactatcataagtaatttcattaccttttaagcataccatgcttccgaacttacctttattgataagctctattgcttcaacaccatatcttgttgataatattctatcatatgttgatgtagttccacctctttgaatatgaccaagaactgtacatctaacttctctatccttaactaacttttccaaatcttcagctatcttatttccaataccaccaagtctaattggatctggactatcttcaactatcttagatactataacatcgccgttcttaggttttgcaccttctgctacaacaattatagtgaataactttccatgtttttttctatcttcaattttttctacaactttatttatatcatatggaatttcaggtagtagtataacatctgctgaaccagctattcctgattccaatgctataaaacctgcattccttcccataacttctagaatcataattctatgatgagattctgcagttgtatgcagtctatctaatgcttccgttgctatacctatagctgtattaaagccaaacgttacatcagttgaccctaaatcattatctatagtctttggaacgccaataacatttactccttttcttgaaaaatctctagctgatgttaatgttccatctccaccaattacaactaaaacgtctacaccctctttttttaaattctcaactgctacatcggatacatctttttttactatttgaccattttcttctactgagtaatcaaacaaattatctttatttgaactataaagaattgttcctcctcttgatataaggcctgatacagctcctaaatctaatgaaataaaatcattgttatataatcctctgtaaccgaatttatatccaataacttcatatccataatttaaaattgctgatttcgttactgcacttattactgcatttaagcctgggcaatctcctcctccagttaatagagctatctttttaatatctttggacatcttctaatccccctataccataatcttcattggaaattattgttccgattaaattatcattattttctgactatttacttaataatatcacaaactttaatttatgaaaagtattaatttacaatatattcattctttaaataagaattgaaatttttaattttaatatttagtcgtttctcttaaattttcattattattcctaggaattttgatcctaaattattataaagaaagactattttgaattttacctacattaattactatacccaaacttacattaagtattatattttataaattaatatttagaagtgttatttctatttttattaataaattccgtagattattaactattaggttataattaacttcttataataattaatcttaagtgctatcattatttaagtttctttttaacatatatgcttaattgcgtttctgaattttattccccatcaaactcttaacgtattcaaataataaatataaatttactatttgaatacacttatttgttttaattcttttttataaaaaaatcgcagactactgtggatacagagattcttttcacgcatctgccttttcgaatgcatgtgagaaaaatttagcggtcgaataaaaaaagttgaattagcgtgtagctaatccaactctttctttttataatgtgaaatttaaaaaaccaaagaacataagtattccaaatactatacctgcacctattctataaactgcaaatacacgcattggtcttttcttcaaataagaaacaaatttatccataacaacgactgatactacaaatgccacaataaaacctactactaatgaaatccatgaagtcaaattcattcctgaatagtcaaattccataagatcttttgcagatgctcctatcatagctggaatagctaaaaagaatgaaaattcagcagctattggtgttgaaaggcctgcaatccatcctcccataatagtcgatgcactccttgacattcctggccatactgaaagtacttggaatactcctacctttagagcttgcattggagttatactgtctaaactctttgttgcatgtttgttactttttctaaacatgttttcaattattattaatagaatacctccaactataaatcctataacaacagcttcaggattaaataaactttttatctttttataaaataataatcctattatcagcattggtatgcatcctactattacatttataccaaagttaaaacctgttttaccttcttttccttttgtaaatatatatctgaaaaattcaattacgctgttttttatcttcttccaatataaaacaacaacggccaatattgcacctaattgaattacaacctcatacattttaacaaagtcacccttaaaattaatgatgcttgacgccagtatcatatgtccagttgatgacaccggaataaattctgttaatccttcaactattgctattattatagctttgattataaataaaatatccaatcccacttaattttcactctctttcttttttgtttacttatttacttttttaaccatattaatatattttaaacctattaggtcttatttcatattaaaaaattattaattttttaataaattcactatatttctctttactctcaccaaaattcactttgctctgtatttctaagataaataatactttgtccaattttaatgcttataagattctaaacataatttattatttcaatatataaatataatgactattccttaatcaaattcttattttacaagttagtcaaacaattaaggagcaacttaatagttcccccttaatctttattattatttctctattacactcattatgcttttttcttcattttctatgtttggtacatagctctttaatactgtaaaattaccaactaattcgtaatctccaagagttgctgggatgaagatactatctcccataagcattttttcttctccaccactatatttaattacaccattaccttcaacacatgtaaataaataaaatcttccctcatcactcgtttcttttacagatgtagtaattttatatttttgtattgtaaaatattcatctaaacaaagatatgatttatcatatccatctctttcaattagaatcccttttgaattctcccctttaagagaaaaatctattacatctaatgccttttctacatgaatttcacgacctctattataatcgtaaactctatatgtagtatcactattttgttgaatttcagcaattaataccccttcacatatagcatgaactaatccactttgcacaaagaaaaagtcgccctttttaactggaatcttatttaagtacttatctaattccccttcttctattgctttcttaaatttttccttatcgcaatcttttgttcccactattaatgaagcattctcttctgcatcaactacataccaagcttctgtttttccagaatctttttcaaccttatttgcatactcatcatcaggatggacttggaccgaaagtttatcttctgctgttattagtttaattaaaagtggaaattctttagtacttatttcagtacctaaaagtttttctccatatagatttattatttcatcaaacgttttaccttttaattctccattttctactttaccagtcccatttttatgacaagctatatcccaactttctcctattacaccttctggaacattatttctaaatttctctaggtgctttccaccccatattctctcgtaatataggttttcaaacttaattggatacatactactctccccctatcaaatgactattttatacttgtttccaagtttatattatataaataattatcttaataaaataattttaaatctggtatttttaatgttgccccgtttcttttattatatgcatcagataaattccttactctattataattttcgcttattgtatctttatcctcttcacttgttttatcatttatgccatcatatgctgccttaaaattaactagccctctgcttaaatctccttctatagctacataataacatccagcattatttagcgttagtatatcatttttatcaatagcatatgccgctcttatttccttaagagcatcctcacctttttctttatttaaatacacagttcctagcgctctatgatatttaatttcttttgaatttattgctatactctttttcaataaatctatagcttcgtcttgtctttgatttgctactttaattaatgccatattataatatacttctgcatcattaggattcattttagatgctaaggtataataatataatcctctagaactatccttaactgtatttccataatactctgctaatttaattaatatattataattaaaaggttccttatataaagcagttctaaaatacggctctgcattttcactcttatcttgtttttccattatctctggcatcaagaatccatagttatctgcatagtctttgtttagagatatactcttttcgcaattcttaagtgcatcatcataattttcatcactataatcttccaatgacattgcgtgatatcctataaatgagtttggatcactctttatcatttcatttataacatctcttgctttttctgattcacccaaattctgatatgtgttagatttaataagtgccaaatttatacttccaacatctttaccttctaactcactaattaaattattagccttttcagcagaatctttatctttagagtaaatctctgcctgccacatcttatatgcaagttcacctgaatcttttttctcaagtgctgaaatcttatttaaaatgtcagtcttattatattctgcaatttgcgttattacatcaaaaactttgacttcatttttatctttatgccatgcatcttttaataataacagcccttgatctaaattattcatcatcatattcattctagctaaatctgccagatccgatgcatttccatcatctcttggataattatcaattatttctttcattttatctttcttgtcatttgccatataaatagtaaacattgtttttaacaaattcttatctgttggataatccatcaaaaacaattcaccatattgcaaagccttatcataatctccgttcataaaagacgtaaacactatataatttgtaagttctctatctttagactcaaaattatctatatttttttgcttcttaccatcaactattttatttctagctaaataaacttttgtaagaagttcattcgaatctgcaaaatctccttttacagaataaatttctgcaatttttaaattccatattggccattcatctttttcttgttcttgatacttattatattcttcaattgcagcatcatacttatcattataaaaatcctcttcagcactattagctgcaatagtaagcttatcttttgatgactcaattctagatttagagattacattcgttatcataaccgcgctcaggcaaattactataattacaggcggagtaaaatatctgtctttcttgaagtcgcttatgtatttaaaatacttactttttttcaaatcatttatgtacgtaaaatatttgctatttttaaaatcgcttatatactctataactgatttcttcacgaataaatcacaccttacttttataatcaattcatacttgtcctctattttaacaaactttgatataaaaatctactttttgactaacattcattaaattgtaactatatattcataaatatattaaaacttttacattttaaatcagtaaatttctagattaaacttctcaatataaatagaattaaattttctgcctttaaatattcccatatccttattttgaatattaaacaattttaattcaaattctatctagtttaagcccttcgtaccttaaaatccttcttataaaaaagcacattagtggcatttagatgcactcatactacttaaagcactgaaacaattgtatttgcagcccaaatctttttatactttccttattgctaaaaaagagcaagatcttaatcctgctcttttttagcactgtaaacattattttttagataattatacattaaatctaaaattaacaacatctccatcttgcattatatagtcttttccttctagtctaaacttacctttttccttagctgcagcttctgaaccacattcaactaaatcattataagaaaccacttctgctcttatgaatcctctttcgatatcagagtgaatcttacctgccgctgctggtgctttagttcctcttttgattgtccaagctcttacttcttgtactccggctgttaagaaactcataaggccaagtaatttgtagctagcttcaattaatttatctaatcctgattcatccaaaccatattcacctaacatttcagctttttcttcatcatcaagacctgataattcttcttcaattttagcacttacaaccataacttccgaattttcactaactgcatattccttaactcttttaacataatcattatcaaaattaccttccataacatcatcctcagagatgttacaagcatatagaactggctttgaagtaattaagaataagctctttataaaagcttcttcttcatcagtaacttctaaagttctaactggtttgtttgcttctaaatgttctttaattctttccattactccatattcaaatttagcagtcttatcaccagatcttgcaagctttatagatttttccattcttctctctaaaacttctaagtctgaaaaaattaattctaaatttatagtttctatatctcttataggatcaacagaaccttcaacatgaacaacatttccatcatcaaaacatcttacaacatgaacaattgctgcaacttctctgatatgagataaaaacttatttcctaaaccttcaccctttgaagctcctttaactaatcctgctatatcataaaattctattgctgtatatacctttttctttgtattatacattttttctaaaacatctaatcttttatccggaacacttactacaccaacatttggctcaattgtacagaatggataattagctgattcagctccagcttttgttatcgcattaaacaacgtacttttacctacgttcggtaaacctaccatacctaatttcatctatgtacattcctttcttatatcgaacttttacttaaagatattcaaaatataccttaacttttaatatacctttaaaaattatactctagaaccttttttatttcaactttatattatcacaaaaggcatattcaggcatctgtaataatcaattactattgaaaaattatatactaagatactgcacttaatagtaattcaaaaaaactaattagatctatattataaatgtttaatccctcataaacttaagtttaaataattatatgatttacctaataagcgacatatgtgcaagtattcctttgggactaaaattatatataatttaccacggttattcctacccaatattcaaatactatacttggttaagcatttattcaatgtcttcaattgaattttatcttatctatagctactgtaatatcaccatttcttcaagtggaagataacgatagcatgactctagataaagttcaactaatattcactttatatttttcttggataaatctgaattaaatatgtaaatttttaagattgaaggtgagaaaatgaataagtctataaaatctttaattgctctttctttagcaatgaatctaattactcttgttcctcaaaaacctgcacttgctgcaagtgataatgataccgattcaaatgaatgttttcaagaagatggtgtctttggagatattttagatgttgataacataagagatattttttcttcttttagtgatgaagatgaacttaactggtattacgttggtaaaggaaaagatcaaattgcagaaggtccaaaggaatccgttagcttcttaaaagaaaattctgcttattacctaggtgatacatcaaaaaaagttctatatcttacttttgatgaaggatatgaaaatggtaataccggaaagattttagatatattaaaagaatgccaagtacctgcagccttttttgttgtcaaaccatacatagacactcagccagaactaataaaacgtatggttgatgaaggacatgtagttggtaatcacacagttcatcatccttctatagctcaaatacgtgataaagaaaaatttgaagcagaatttactggagtagagaatgcttttaaagaacttactggtcaggatatgcctaagttttttagaccacctatgggtaagtattcaaaaaaatcattagcaatgacaaaggatttagggtataaaactatattctggagtttcgcttataaagattggttagtaaataatcagccttcagaaagttatgctgtagagaagatatgcaagggtgcccatccaggttccataatgcttctgcatgctgtctcaaacacaaatacaaaggtattatcatcagttattaaaacacttcaaaaggaaggttacgaattcaaatcacttaatgatttacctacggaatagtaaatccagccatagagtatattaacaattccagtactatatacaatggttagattcacttaaatactttcaaaacaagaataactatagatattcaattataaaagttatatcattttagtgtgttttaaatttatcttagttacatactaaaatgttttaacttttatttttttaatctatagtcatctacttatcattactagttagagaacttttaaaaagtatctcctaaaccagtattttatataattattattttataaatttacttacatcttcgcttactttaacagaagaattttttgatacaataatattttttattattttaaaatcctctgcactatacgacataggattaattaagtacgtgtcctctgcagaatttttattcttcttcttatcatttttataaaagctaattataaaaaaatcttttctcttatttttaggctcatttcctttacctataagaatagcttttatattactatacttaatcgattttattaaatcattatttctatagaactctattgcatcctctttaattaatatgtcttgactatactccacaaaaactgaaagtgcggtaactattcctgcaaaaaaaagcacccacataggagcactttttaatcctccttgtaaagctccaaagattattcctataattatctctattattgcaactcctatcattacaccattttttttctttaaaacaataggaaattttgcgttttccaatgctaattcctccttaaaattactataatatatagacagactaagtgaaacctgaacttatgcatattttttatattcaaaatatatatcttatgttaataaatattatacagtacatatgcaatctttttcaatacttgttaatattattccttagtcatttattaatccattaatcaccaaaaaattaaacgtatcaaaacctcatatgagcacaaaatataaaaaaggaggtgtatcatatgccacgtaaagatggaccacacaaaccaggatcaagcaatccaatgcaaaaaggtgtaagaagaagaagacttcatgctaaccaagataatgtgggcgatccaaaaaataggcccgaatacgaaaattttgatggagaaccagtagaataaaagtacataagagatacttactttaattgaattcttagtaagtatctcttattataattaatcatttttgcattgctacatcttgggataaattattttatttactgtttctgtaatcaattctttttctttagctgatttttctatgatactatctaattcactatcaagtttctcaaaaaattcttcatttctaagcccatttaaatttactttaacatttattatggaactttctatagcacaatgtagtaaaattgctgaaattgctaaatctgatagcaacatcttatttccatacttcgccataacattaaggttcttataaaattccaagctttctctagctaaaattaaaggcgcttccatagactttatagtattctcttttatagccaattttctcttttctttttctttttcagtatctttaggcaacttataagaatccattaacttcaaaaagttctctctatcttcttccataagttctaaactccttacagtgaactctttagattccttttgaaattttattatactttctttttcatcctcttgaagactcatatatgcttttttgtctactgtcagagaataaaccatagaattcaatgcaccagataatgctgcaataagacccgccacacttccgccacctggagctggcaaatctgattctaattcacctaaaaattgttttatagtttcgtcacaaaatttcatataatattattcccctatctatagtcgtatttttttatattacttattgctgatacctaatctatatttttattatctagaatcgatactagataccctaagtatatccaaaatatcattgaaataaaacttattgtatatactaatacactttcaaataagtttactgcaagaatacccgctataattgatgttattactgtcatctggtttttttctcttctgtttaacttatctagatgttgtattataaacaccaagatcattgctatgaacataagaaatagtagtaacgaaataagtccatttaccgcggctatttgcacatatatattatgcatccctccaagttcaattccaggtaaataacttcctattcttgcatttctaaccgcttctataagattactatttcctacaccagtcaaaggatttttttctattactacagatgctgaagtccaaataatattcctctctgttgtaaaagcctccaaatgacttttaaccatttcaaaaaatactccgcaaaaaagtattggtactaaaacaagtgccactctaatatatttatttttactgtatataaatatagatagatatattacagctattatcaccaaatatgcacttcttccatgtgaaccaatcatagttactgcctgtaatattatatttcccatccacaacatcttaagcttgtgacttcttgatatataattgagatatacacacataactatagataatgaagttgctatagaaagagcattttcattttcaaagactccctttgtgcttccaaataccacttgtccgatttctatatttattcccgaatatctcattgccagtgatataatagaagcaaccatcataaagattacataagaataggtaattatgttcatctctttaataagcttcttttttgctctaaatacatcaactgtaaatattaccacaaatataatcaaattaacaatccaatctttaatgttattaacacttctatagataaaaatgttaaatattaaagtcactatcataaataatgccaatggaatatcaaatttataaatttttcttctcttatatccttcgataaccatgaataaaattaaaagcatcccccaagctattgttatattgcttagaatttttattcctggcacatctttgagcatagttacaaatgttaggcttacaaataagtacaataacttaaaataaaatttattatctaagaaatcatatatatttttaattgcttctctcatatacttttttatacactccttttagcttttcaactaatactttttctgaatagctaaaaattgtttgttctctaattttatatttatcatacattttatgattttcttttatttttcttaacgcttcggctaaatcctccacatcattctttttagctattattccattatcttcttttataatatcttctgcgccaccattatcagctccaattaccggcttcccacatgcaagcgcttcaatgtatacaactccaaatgtctcatgttcagatggtaatgcaaatgcatcacattccttcatttccttcgaaacttcttccctcgataaagctcctagaagtattacctgcttttcaatattcaattctttaataagtgattccaatgatggtttaagggttccgtctccaccaattcttaatcctacattttcatttttgaaaactctagaaaaagctttaattaaacattcaattccctttccttcttcaagaaaagcacatgaaaaaaatttaaaatcttcatccatattggtactctttttaatattttcatccacagaaaatagattcaaatctaccatgttgtgaataacttcgataggtttatttacatattcttgaatttctctttttaatccagacccaactgcaatcaaataatccgaattttcataagcattgtaaatatattttttataactttctctagtatactttgcatacttaagagatgaatgttctgttaatactaatggaacattatatttcttacttatatatgaagcagctattccccccaaaaagctgaatgagcatggataatatcaacctttccttcatttttaacaatttcttgatacatcttatccattcttttattgaaactcttaaacattaatggacttttaggtaaataattataatctttatatctataagttctaaggttatcttctacattaaagtttatgcctctcttttcatgaatttttccaaacatagtaataggccaaatttcattgtatgcgacagtaatcttctctccactatttgaaagagctttaaattgttccttaaaaaaacttccatgaactttgtttcttggagatgaataccaagatggaataaccattatgtgcatttattcacttccttctaatatattgttcaacctttccacaattgaattccattcgtaattgatatctggctcacaatatatcttattatttttatgcatttctattaatttatagatatgattttttatttctttactattattctcagttacaacacattttctatgattttctaccactcttttaattggatcatctttatccccataaataacaaatatcctaccttgtgccccaaaatagtcataaattttagctggtatttgctttgaatttttattaccaaataaaagcaaaacctctccatttaacatgtatttaagcgcctcatcgaatggtattctaggggatacattcgctatttctaaattttgcagtttcttcctagcctctatatcatctatatttccaaaaaacaacacatttaactgattatatatttctaagttctctgtttttatttcttcaagcgcttttacaaaaggtcctatatctctaagcttagaaaatatttctcctgtatatattatgttaagtttatctttctttataagcttaggcgctttctcatgtaataatttatcgtataatttcgcatcaaaacctctatttaatataaaagtcttactattatctaaaatattataatcttttaaatattcatctctattggcatcagtcacaaatataaatttatctgccagattaacaatatctctttccatattcttttctaaaaccttttttacaataaaagatttttctcttgttgaatctttaagccatggatcactccagtaagtaatccatggtacgcttggatactgcttttttatataataagcacataaatgtgaagatggcggctcatgcatagaaaatataacatcaaatttttctttctccattaactctattccatattttcctgcttttcttgcccatgaataatacatatctggtattgctaatgcattttttattttccgtaatacttttcttctattagtatttcctatttttgaaggcgaattattgtagctttcactatttcttggcataaactttttaaagataagtccaccatcaataatatgcgttttgattttatcattcatcatagagcgtaatacttcatcataatatattgaatctttaggaaaattaacagttagaagatgcacttcattatcattaatctcacttaacttatttagatattgtaaagtttcaatagctgctgaattatttatcaatggtgaatagcaggcaataaataatatcttcatataccatcctcctatctttttatcttttttaaaattaattcttttatttccactagttcttcaaccttgaataaataacataaaccaagatatatagctgctccaatactcactccaagtaataggattgtaattgaattaaatttattttcgaagtaaattaataacgttaaaagtaccgctcccatgattattgaattcattattattatacttactttttttaatatctctgttatgttaaagtttttttctaatttaattatatttataaataagagtaccgatgttactatcatagctataactgaagctaatgctattcccataatacctatatacttagataaagttatgctaaatattatgttaatcacaacaccaattataccatttattgctgtcacttttgtctttccactggagaataaagttgaattcaaaatatctcttactcctgtaaaaaatattcccgctccgtatcctaacaatgcaagtgttgtaatatttatcgcataaccagtaaactcgcccctagcatatacaattgttattatgtctctactaaatatcataactccaacactaattggaattaataatatagataaatatataattgatttttttaaaatctctaaaaacccagacacatctcctctatttctcatattagccataagaggatatgctacgctggtaactgatgttgttataattgcatttataaaaacaattaacttctgcgcataatttaaagctgagactgaaccatctggcagcttcaacgcaatatactgatcaacagccatatttaacgagttcgctcctgctcctataattactggaagaatcaataccataattgcctttaatctatcatctttaaagtttataaaaagtttatatttatactcatgtgtaatcaacgatggtacctgaactgctactctaaaaaaattccctattacattggcaatggtcaatcctaaaatatcataattcctaaacaacaataaatataatatcataggcaaattaaaaaacaatcctaaaattgacggaattacaaaatcttcatttacttgtaataatgcggtaaaacatgcattaaccgataaaaataatatattcacaagtgtaatccttaataactttattgcaattagtcctgtttcctcagctggccccagtatatggactatttctttcgaaaaaaggcttgttataacaaaaagaaagaatgatataataaaaagtatgtttattatattgtttgcaaaatcattcatctctttttgtcccttttcagctcgaactttgctgagcattggcaaaaatgcagttgaaattgcaagtccaactaaagtaaatattgtttctggtatagacactgcaatattataagcatcagtatatattccagcaccaaaatttttagcaataagcatgtctctggcaaaacctaaaaatctactaatcaatgatactatcattattacaaatgtagattttattaagctacttttttgtttcatttaatcacctatttatttctgtgttataatgttcagcttttctattaaacactaatctgcttattcctatattttaatactaacaataaaaacttaggaatagccattaatctctttattctaaaaggttctttcgcaactctgtataaccattctaagcctagagatatcatccatttgggtgcccttttgagctcacctgcaaatatatcaaaaacaccaccaacccccataaagatatgcacatttgaatttccaataattttttcaataaatatctcttgccttggggaacccattgcaacaaaaacagcccatggattcccactttttacatcttcaattatatcactacaattatttaaatcaaaaaaaccattatgaaaaccagatatctttagtttaggaaactcattctttatattttcaacacattttttaatagtttcctctttcgagcccaataaatatatagatctttcttctaaatttgctttaattaatatctctctaaatatatcaattcctgctatcttttctttaacaggttttcttaatatctttgaggcaataacagttccaactccatctggtataataattgaactctcgcttttaaaattctttttaagctcaagattatttaatccattaaagagaacttctggatttccagatattatatttaccttttcaaaattttcaatatagttcattaacgcatttttatccctattaaaaatattaaaatcaagtatttttgtaaacatatttatctcctaaatcttaggcaatatatcgtatagaatttacaattattaattaaagtctgataacaaataaaaaactatgttaaccaaaattcaaaattgaaaaatatacattgccatgtttattttatagttctatttaacatttgatctatctctattacgatatcatcttccggagctattttttttgcaagttccaaatgaatttttgcttgctctttgtctcctaagtttatatagcacattactatattagtacagatttcaacttccttagaagcttcaaaggcttttctaaaatattttatagcttcttcatattcaccaatacatgcataattcattccaagttcattaactgtttcaagacttcctgattctatagtaagacttttattcaagtaatgaatagctttattatagttttcaattcttctatacccaacacctagatagtaataaactaaaggattttcattaaattcttcacttagtggtaataacaattctattgctttcttaggttcatcttttaaatattcaaccgctttctcaaagtgacttatattagtaatatcccctattatcttatcaatttcatccgtttttttaccacccttatttatatactcatttatttccacttctgcacctttataatcaccatcatctttaagtattaatgcattatacagatgtggttctggcgatttttcaaacttttccttaaattcttcaatatcttctaataaaatttccgaaaatccagaatctttttctcttattgtctctcctatcgctagaagtttagttaaaatttcttcttctcttgtatacctataaagaccttttagcagaatataagcatcttctaatctatctttttttattctatctgcaataagactcttcacacattcttctgcatctggtatataagatagaattgttccataatcatcattatatttaacatttttatctgctccaaaagtaataaatataccctccacaaagtaatatataggcaggttacttaacttaacttcatcatttacatttgatacaacataatccgagcttataggcaaatacagatcatcattcttaaagttaacgccttctggtatattaagacttcttttgaacccttctttattcatttctaaaaataataatttacttaatttatctttatacattgtcttgtaattactcattttacacctcttgtttaaatctcactttatagatatccaactctagaactaaatttatatggtaacttaccgaaatcataaatattttgattccgaaaagctatgaaaatattgctgaagatctagtaaatatgtttatctaataagtcaaatatttaattatcattatcaatacttaaccaatttataattctaaaatttagaatgcacaattattgagcagatttcccaggaaatttgtaataatacaattctataaatttcttaaaagaatttatttcttaattgtgcagtgtacattaaatttatcaattgtttaagtattcattaataataattggtggacattcactttttgatttcataattaaagaaattgctatcaccaaaagatgatagcaatttataaggaaactcgactcacattcgttcgctgagtactcacagagtaagcgaccatcatcaaatcacagatttggctgtctgcttaactgattcacacaaaatctcagattttagctctctacttatggaaacttagcttaattgtgaattaattatttccattactttttctttaaatgtagcaatatctttctcagcattgtctaagctgttgctcttaactgctaaataaactttcatctttggctctgttcctgatggtcttactacaaaatatgaaccatcctctaaaatgtactttaatacatttgacttaggtaagtcaataggagccttagtgttatttacagtgttttcctcaacacttaatttgtaatctaatcttgtaacgattttcacaccattaacttcacttgctggattatttcttagtgcttcaatgcagtttgctatcttctcttgaccttcttttccttttagttctaatgatacaagagtttctttaaaatatccatacttttcatataaatctattaatgcatcataaagactcttgccttgttctttataatataagcacatttcacatactaacattgctgcaataacagcatctttatctcgtacaaagtttccagcaagatatccatagctttcttcaaatccgaaaatataatttctatctcctgcatcttcaaattctcttattttttctccaatgtatttaaatcctgttaatacatccataagctcaatatcaaaatcttcagcaatacttctagcaccttctgttgttactattgttttaattacaacaccattttgtggcaatttattagtttctttcattgaacttaatatataattagttaataataatcctgtttggttaccagttaataccttgtattctccagtgctatctttaactacaagacctattctatcgcaatctggatcagttccaaaaattatatctggattttctgttttagccatctttaatgctaattcaaatacatccggattttctggattaggatacgatgctgttgggaaatttccatctggagcttcttgttccttaacaactttaacattactatagcctaattcttttaatacggttcttactggaacattaccagaaccatgaattggagtatatattacatttaaattactagctttttccttaactaaatctgtccttatagttaatcccttaactttttcatagtagaccttatctacatcttctccaatatattttaatagccctttatctaaggcaacattttcatctatgctttcaatctttgagaaatcatctaccgctttaacagagttaattatcatttttgctttttcatctgttacttggccgccaaattcatcataaactttatatccattataaattttcggattatgtgatgcagtaattactataccaccattacattttaattctctaactgtaaaagacaatacaggagttggtcttaaactttcatataaatatacttttatattatttgcacataagttaagtgcagctgcttttgcaaattccttagacatatttcttgaatcatatgcaattgcaactgaaggatctttaaaattatcatttaagtaattagcaaatccctgagtagattgagcaacagtatatatattcattctattgcttcctgcacctattacccctcttaatccaccagtcccaaaatctaaatcttggtaaaatctatcttcaatctccttttcgtcagatatgctctttaattcattcttagtttcctcattaataaagtcagagttaatccacacgttatacttttccttataattcattttctgatcccctctctgtgttttttctcctatacattatacaatatttatccataatataaaaacacttttatatattttgcatcatatataaaaacttggatgcattgccaagcattttacccttctaatctataatattaactctaataattaaaattatcctaaaatatatctttgaaacactgtcatttttcataacaatcataaattcactatacatactctaaaaaacaaaaaatcaaccatctaatgctcaattaaaatggttgattataatatttaaaatttaactctgtttatctgtaattctattctgtttcttcttccttagccttttcttcttcacttattgatcctataaccgttgataaatcatctaaaacttcaattccttcagcaaattttagatttttaaaagtataaactgtcccagcttgtccattagaaacatctaattcaacatcctttggtaaatcttttgctttacaagatacctttactaaatctctttgagtttgtaatattaatcctttgctttctaaaatgcctttaccaacaatcttaattaagacttcagtatgcattgtatcatttgctgctacttcttcaaaatcaacatgaattgctttatttcccaaagcatttctttgaatttccttaattacagcgtttcctttccttccatcaagattaaattttactattccatgctctccactagctgaggtttcttttagtaatgctgattcatctacagtaaatatttcatttcctatttcttttccataaattacacctggaatcttgccttctcttcttacctttctagcaccatgactagctgtttttattcttttagttaaatttaattcctccattataagtacctcctaaaaatttatttttcattttcttgcaatgtatttaattcacattttaggaatgtacattcacgttggaataaaataaataggcctattacatttacaaggtctaatagtttttctaatattaattttatctgaagaattatgaaaagataaaatcaagttagacttacaattaaacatttaaaatcgcctctaatatctattaaatttttattttcgtaatttaattacaatgtatattatagcacttaattaccagtttacacaaaaaataacaagtaatatattaatataaaacttgttatttttataaatttagtttctttcaattctaactttgcttccacccatacctgattctgctggagtaatcataagttttactggtactctattctttattgcttcaacatggcttattataccaaccttcaatttttcattatgaatcctttctaatgaattcataacaacttcaagtagatcatcatctaaagtaccaaatccttcatcaaggaaaaataattctaatggtgcagttcctttaagctgaatctgtgctgataatgccaaagctaatgataaagatgctaaaaatgtttctcctcctgataaagtagtagaatctcttttggctccaccatttttataatctctaattataaatctgctattgtcatcaacctctagtccataatttccatgagttatttctttcaatctcttagatgcttcaactgaaacatacttaagcttacttactgctacaaactcaacaaatttctttcccttaaataacttttccaaatcaccaagaagagccaatttatgttctagtttcatcttcttatctaagagatctttctgctcttccaacttattttttatgttttttaattcttcatctaccttaattttgtcttcattaatttcattaaactctttttctttaatatcttttaagagttttatttctgtatattctttttcacttaactctttaccatctattttattaagtaaactttcaattgctccatttacttttgatacttcacttttataactttctacttttaatttataatcattaatttcttcttttccaattatattttttttgacatcgtcaagggaattaaaaccttcactgtctattgcaacttctaactgagcttcttcatctttttttcgtttacttaattctttatatttactgattgcagaaattaatcgctcattgttttcattaaattctttctctattttatttttattgttttcactttccttaaactcactattaatattttcaatattttcctgaattttatgtagtagtgaaaccagatcatctgtattatcgactttgttctttatcgcttgtattttttcttctttacttttttcataattacttaattctgtattatacctagttaaattttcttttgctaaaataacttcactagttaaattttctttattcttttctaacttttctattagctccctgttaactttaataacctctgataatctttctctctctttttcaacagctttaatttcttcgctttttttattaaaatcagttactaatgtctttgcccttagcgaatccaatctattttttaaaatattcaattcttctgtattttctgtaatactcttttccaaatcttcaagctgtctttggttagttctaactactgctcgtaattcatttatttctccggttttaatattaatttcattcctcagcttattaacacttttttcaagttcttctttagctttagaataactttctaaagctttttctaaatttataaattcctgttttaactcttccaaaggtttttcattaaacgcagttccgagcttttcaatttcttcaagattaactttaattttttcgttaaaactatttaccttagtttcaccttgagttattttgctactaataatctttattgaattttcttttagttttattttttcctctacattcttcacatcttgaacttcaaaaatcctgatattttctttcatatgatgagttgatccacatacaggacatgtatctccatctttaagttcctgtctaagagtatgtgctaaattttctctcataacctccctttgagtattttttatttcctctagttctttttcaagttgcttttcttcttctcttctacttaatatatctatttgtaagttttttatctcttctctagagaaatctatttctttgttcagctttacataactgctccatttttgctcattttccactatcaactgttttaaattaactaaatctttttgttcacctggcgaatttttaagtaaaaactcatattgtttatctttatcttccaaactctttttttctttatctaaaacttcccttaaagcttttcctttaagtatagtttcactattttctttttcaataactgctttcttttgcttatccttaactagaattccatttattttttctaacttttcttctacaattattccttcttgaactgcttcctttaaactttcttcaattttcaaattatcatatgttttttcgtcttcttttattaatttatttttattacttatttcttcttctattttaatgagctcactctgtatattattatttttagcatcacattctttaatttgtgcctttaataaatctattttattttctatctcacgtatcaaattcttttcttcaatagcatctttaactttttgttcctgcatcattaattgaggaagtttattctcttttttatcttttgccatgcaccaaagttgttctatcttttctttttcttcttttatcttacctatctttgattttaattcttctaactcaatctcatttttatcaaaggcttttctagtgctttcaaatgcatttaaataaggtagtacctttgctcctgcctcgcctagctttatcttttctatatatgaatttatgttttcctctttttcctttaatgtttgctctttatttttataatatagtaaatcaagctgtagcttccatatttcttcattttctttatgcttcttttctattatatctaattcctttttcaaagcttccagattattttttaattcctcaagagcgttttccttttcttttaatttttcttgactaacatcgctgtatccacttaattgtcccgctaaaatattgctatcagttcgctctttgcttatctttgcactaagttttctggataaattgtctccaaattgttgaaggttaaacaacctttcaagcatatcacgtctgtccttaccttcaagctttaagaattcactaaacttcccttgaggtaaaacaacagttcttgagaaatcttctaaattaagacctactatctcctcaactttcttatttatagttttaactccatctgctaaaatttcttcttctgaacttgttacttcaacgattttacactttccagagcttattccaccatctttttttcttttaaactccctgtcaatgatatattttcttatttcactacctgatatttgaaactcaaaatttacatttaatctgtcacaattagtatttataaaattggagctttttcttgatacatttccatataatgctagagttattccatctaatatggttgatttcccacttccagttggtccaaagattccaaaaaatcctctatctgttaatttatcaaaatctataatttgttcatccatgaagctatttaagcccttaatcctcaatttgattggtctcatctgttccaccctcttcgtttataattgataaaagcaattccataacttcaccttctggaggagtgcccctttctttaagataaaactccttaaatatttcctcaaacgatttttcacttaagtttaattcactctcttcttccaatcctttaaccttaggcattatttctaatatatctgcttttaattctttcatttgttttatttcatcttctcttatgtatctatctgtacttatttctaaatacacccagcaatctttatctttattttcagcacatcgtaatattgcatcttcaatacttgagcatttccaaatttctattggtttatatacccttaagtttatttcttgtatgtcacattcttcattagcttttgcctcaactatataacatttcttttcaaagctaacctcttttttgttatagtgaattggtgacccacaataccttgctcttttatccgttcccggaactatttgtggtttatgcacatgccctaatgctatatactgtgcttccttaggaaaacaacttccatctactatataagcacctcctaattgaatgcttctttcagagccaccttcctcacttcccattgcaaatagatgcgatattataagattaattgtatcttctctaaaatgattttttaatgaattgaataaagaaaatatcttatcactataggatttagctttttcatcttcagcttccatatagttatagataacttcattcagtcttttctcgctcggataaggcacagttaagataactgctttttcactattaatttcaacttccacatacccttctcctgatgacaaaactttatgtttcccatactcaccacaaggaactatagtttttggtgtcccaaccataatgattccatgatcacgagcaagtggacctgccgcaaccaatctctctggattatcatgatttcctgatataaccaaagtaagtctctccccatttttcgatagtctctttaaagtatcataaaacattttttctgcccttgccggagggtttggattatcataaacgtctcccgcaatcatgattaaatctatattattatcttctacaatcttaacaaaatcatttaaaaactcttcttgctcatccatccggctttgtccctctaaattcttacctaaatgccaatcagctgtatgcaatattctcaaattatatctcctcccattaggcccaatttatatttacattatagcctacttaaatagattttttccaatactattttgtggatatatatttgatttaattatcccaatcaaatgtatgtgtacccatacatttgataaattgtacatatattaatataataattttattatttgtattgagttttattatataaagcatgctagatataataaacaaagactataaaaacctgtattcatatacagcaagtaatttataaaaaaggtaggtaatatttatggaaagaagtaaatctttaaatactagtgaactagtattaatggggctaatgattgctttaacctatatagcaggaagcataattaaaattccatcagttggaggctttgtccaaataggggactgcatggtattcttatcagtaatagttctaggtaagaaaaaaggagcaatttcaagtgctcttggtatgtttcttgttgatgcattaggtggatattatttttgggcaccctttacgctaattattaaatggggaatggcttatattgcaggatccatattagaaaaaatgtcagaaaacaaagttactgtaaggtatacaattgcatttgtatccagtggtatatttatggtgattgcatatttttttgctggaataataatatcaggctttttaacagagaaaattgggctaatacaaggaatggcatattcagctaaagatatagttggaaatataattcaagtatctactggtataataatagcattaccattaagtgcagttgtatcaaaagcaaaacaagctgtatttgctcattagatttagcttctaaaaatcattcaaatttttataacagaaatttttaaaattttctatcgctaaaagtctcaggtgattccgtatcctgagatttttttatctgcattttcaaattcaactaagaaatatctaggggatgaatatattttcctttttgttctcttttaaaatgtccccttctgaattagctttattaataatttatgcttcagagtagcctagatgtcacctatttcactccaattcaaactcttatataataaaaaagtgactacatcataataattaaaaaacttaatatgatacagtcacagtaattaataaattttcaacctctattttatgctctgttctcctctgtcttagaactttccattattttaggcattatcattgatgaaagtaacgatataacagctattcctataagtattataaataaaaagtgtaatgaactgtttaatgagagtcttatctgttcatcagttaccgctgaattatacaaattactcggatcaactccatttattcccaactgagtaaaatacttaattatatatatattaaatatactaccaaatatacttactcctatagtttgacctattgttttaagcaatgaattagccgcagtcgcagcacctctcttgttatattctactgactcttgaattattattgttaaagttgtaaatgctccaccaaatccaaatcccattatgaaagcatatattattactaataatatagaagattctgcattcaatgtaggcaataacgctgtactaattagtaagataacattagatataagtattactattttcccaccaaactttactatacactttcctaaaattactgcagctataagccaagcaaatgacatgggagctagtgacaagcctgatatcttagcactgtatccaagtacattttgtatgtatattgggagataaacattcgaacccattaatatagctgaagccaagaagcttattaaattcacaattgaagttgtctttgtaaatatatcaaaaggaataattggctcttttgcttttctttcaattatacagaatgcaactagtaatataacagttgcaataacggataataaaataaatatgttattgctagaactcatatcttcatttgataagaagatattcaaaaatataaccatcgccagtgataaagttataattccagcaaaatctatactatgttttttcttttcgaaaacttcatccaaatttctttgaataagcacaactgatattattccaaagggaaggtttataaaaaatatccaatgccaagataataaatctattaaaattcctcccaaaaatggccctactaaacttgcaattccccacacagaacttattattccttggatctttggtctttcctctaatgtaaatacatctccaataattgtatatgtaactgtaaatattgctccagcccctattccttgtatagctctagctcctatcagcatgtacatagtttgcgataatccacataaaaagcttccaattaaaaatattactattccaattgaaagcatattcttccttccatatagatctgatagtttcccatatataggagtagtaatagcggaagttagtaaatatactgaaaaaactgaactaataatttcaaatccttgtaaatccttcactattgttggtatcgctgtcgttacaacagttccttccactgctcctaaaaacattgctaccattaatgctgctgcaatgcttctttttcttgaattcatctttaaatcacttccttataaatttcctttgtttattttaaggtcaactttataattatattttaacttagctatttatacaacattataattatattttaacttgatgtgctactgatttatgatatagtatataataaaatattcaataatttaagaggggtaattatatgacaaaatcgacaatgtcaatgtcttcattttttcgcaatagatttgttcgagtaattatagcttcttctatttttctacaaataggaatatgggttcgtaattttgccatattgttatttgtaatggagaagactaataacaatcccattgctgtttctttaatttcagttgcagaatttgctccaatatttatattctcatttattggtggaacctttgcagatagatggcgaccgaagcgtactatggtttggtgtgatttactaagtgctatttctgtttttgccgttctgcttacaataatctttgcaacttgggaagctgtattttttgtaacatttatttcatctattttgtctcagttctctcagccctctgcaatgaaattatttaaagtccatgttcctgaagagtttatgcaaactggaatggctattttccaaactcttatgtctatttttatgattataggaccagcattaggtactattgtttttcaaaagtttggaatagatatttctatatcagtaatgggtgtagctttcttactatcagcttcagtattaaccctattacccgctgatgagataattgaaaagacagaaactgcaaatcatttcttggaagaattaaaagaaggtttcgcctatgtttggcagcaaagagagttaactatacttggatctgtttttgctgtatcaggccttgctgttggtatcatacaaccacttggggttttcttaattgttgaaagacttggtcttcctaaagaaaatcttcaattattacttatggtaaatggatcagcaatgtttattggtggcggattagttatgacaatatcaaagaaagttatgcctcaaaagcttcttgcaataggacttatagttaacacaatttcaatggttggcatgggattatcttcaagctggattataattctattgttccaattccttaatggattttttatgccttgcattcaaattggtattaacacactaattcttcaattaacgaaatctgagtttgttggaagagtaaacggagtattaaatccaatgtttatgggattcatggttattactatgtcaattacagggtggcttaaaagccaattttcccttactattctctacatctcagcaggcatactttttctaataggtgcaatgcttacttcattaatatttaatacctcaattagtagtgaaatagattcagcagaatagaaaagtgaaaaagcaccactagatgttataaattatgatatctggtggtgctttatcattcttaaaacacttctatttatttcaagaatagaaaaatcattacttttctattggatacttaggacctgttagatctagttgataaaaaactaaatccaaccatttaccaaatttatagcctgctttagttactgtgccagagtatttaaacccgaatttctcatgaattttgatactaccgtcatttaaactatcaatgcaagcaaccatagttgcgtactcatctctattagcagcatcaattaattcctttaacaatatcttccctattcctaaatttctatagtttttatgaacatatacagaatgttctattgtgtacttaaaagctggataagttctaaatgatccgtatgtagcaaatcctacagctttgtcatctttttcaaacaccaatagtggacatccatcttttttcttttcatcaaaccactgttttctttcctcaagattatgcgcagtataatcataaatcgctgttgtatttaatatagcatcattgtagatctctaaaatatctgctaaatctttttccgttgcttctcttatcatttttcatatccctttcaaaataaactaatcttcctatattttaacacctatgtgcaatatgtaaaattatttttttaatagctccattttattaatttttatagtgataaaacaatcctgaattacaaataattaaataataataaattaaactaaataaaaaaacagcataaatgaacttatttgcctatagtccatgtatgctgaactttactaatatttttaattattcatctattatcataaccaatgaaagattggctccattttcttatatgtacaaaattctttatatcccagttccttaagttcattttttacataagaaatcttgcatcctacatcatcttccttatgcgaatcagatcctattgtaataatagttcctcctaattctctgtataactttaatatttctctagaaggtgtcaaatcatctaacccatatctaaaacaagatgtattaatttcaattccttttccatgagaaattacgtgaactaagatttcttttacaatatctcttaccttttcaaaaggatattttcccatcttatcatatctattaatcatatctaaatgacctaaaacactataatcattatatttttttattacttttaatatttcctcataatatttctcattatattccttttgtgtctttcctgtttgaaaatcctgtgtccaaaatgccttattatctacctgatgacaagatagtataacaaaatcaaagtcatattcattaaaatccttttgaaattcatgaatagtatgttcttgcatcccaaattcgattccaagtttcatagtaattttatctatatatttttctctgcatctattaaattcatttatataagctatataattgcaatttatatctactttcactccataatcaacatgctctgtaaagcatatttcatcaattcctaaagatattgcctttttgatctcatcttccataggataagtggaatcatcgctaaaacttgtatgcatatgataatcagctaacataattaaatttcctcctaaaatattattacaactattattactatttcttcaatataaacttctcaattaattcagcgacaacaccttcgttattatcagcttctgttgtataatcacaagctctttttacatcttcaactgcatttcccgacgctactgatagacctgctacttttaacatagacatatcgttgtagttatcacctacagcaattgtgtctttaatatctatatctaaaatttttgctaaattaattagaccactacctttatctacccctaatgaattaaattccatatatcgatttgacgaataacttacagcacaatgcccctctgtaatacttctcatatctggctcaatacccatcaaatatggaacatttatattttgatatataatctttgcaattggttcctcttcaagcaaatccactgtattttctttcataatagtacactctaatttttgatttttaattctttctttttcactttgtgataaattataaatatataatttatcttttgtataaacatgtatacaaacatccttatttaatccatactcaaaaatttctttcatcttatcgaatcttaatcctttaaattgcagtagcttgttatccttattttctgttaaagcgccaccattaaaagaaataatatattccccagcctgatcatataagtctaaaattttcaagtcattctgaatagaagaataacctcttcctgtagctggtacaaattttactccatactctttctttgctctttttattaaatcaatatttctttgacaaattatatgattatcatttaataatgtctcatccatatcacaagctattagtttatatgccataattttgcctcctcctatattgcgcatttttatatatacttttttaaaatatttaaaacaaaatctgcttctaagactgtatatttctactactttaaaaagtcactttcagatttgattttattgtagctctccaaagaattaaataatgtatgaatcttgtgctgtgaatatatactctacttaataattttcttcataaaaaaataaactgcttgtactctttaaaagtcatctttataatagatgctcaaatccagttataatttctacaatataatttatattctaactcaattgatattttaagtttataattcttcagttcaatttgatgataataatttttattaatgctaaaataaatatatatgttgcaattcttaatggatatttcataattgcagctaaaattctttaattatttttagaattatgatgagcaattattttatcaacatacataatacttttccttaaaaagtattaatgacaaatttaattgtttattcacgacattcattaataaaataattcatctaaaaatgtaaacttcaccaaggagataatcatcatgacaatttataatttacttttatatgctaataatttaactgaaacagagaaattacttgcaaattacatattggaaaatcaggagcaagttgctggtatgtcactagatgaattagccaaagtatctttttcatcaatctcaactatacacagactatgtaaaaaaatcggattaactggtttcaaagaatttaaaatcaagtttgttgaagaactatactcaaaaatgaataagccagaaaatattgatataaattttcctttcaagaaagacgatacacagtttcaaatcgctagtaacattaagcagctttatattgataccttaaccaacactttttccttctttaattccgaacagctagaagatgctgttgatttaatttataatgccgagatagtcgatgtttatgccgttacaaataacatacaaacggcattgaactttcaagataaaatgcaaagcatcggtagatacgttaatgtttcactaattccaatgaaccaagtataccgtgctgccgcttctaataataaaaataagcaagtcgcaattattctttcttattctggtaagacacctgaaattaaggaaattgctttagttctaaaacgtaaggaaatagaaaccttagttatctgttcagctcaagaaaactatttaactaagttatttaaatatcatatatttgtttctagcaaagaaaatttaaaaaagaaaatttctcactattcatctcatattgctacacaatatgttttagatgtcatattctcttgtatctttaacaaagattatgaaaaaaacatggagtatcgcctaaacgaatttaataagttagatcatcgccaggtagaagaatgacctaatctttagacgtttatgcttcgtacttagtattacattttgttcatttacattatagtagataactattgataattatatacatgcaatcaaaacaggtatttattttcaaatattcctttaaataataaaattatctgaaaatatttttcagataattttatactcatagaaatatataatttttatagatttcaattaacattaaaaacctagccagcttgtcttcattcaacataattatttcttactaatatctttttatatttatacaacaattatttaatctctctcaaacaattgttgtaaatcttcttttgataaacttcctaataagccgctatttttaagttctcccgttaaaatactgtcaataagttgttttttatcttcttgaagcaaaatgattttctcctctatagttcctttagatactaacttaatcacctctactacatctctttgaccaattctatgagctctatccgttgcctgagcctcaactgctggattccaccatggatcaaaatgaataactaaattagctgatgttaagttaagtccagttcctccagcctttaatgaaatcaaaaagacattcacaaactcattagtattaaaatctttaaccatttttattctatttttaggatttgtttttccgctcaaatggaaaaattctattttctccttatttaagcgatccccaatcctatctaatgcagaagtaaattgtgaaaatagaagtatcttcccaccagaatcaatatgatttttaatgatttctactacttcttctattttcccacttcctccattatagtcttcaagtataagtgaaggatctaaacatatctcccttagcttagttaagtatgagaatatctcgattctaccatctttgttatttttcattgcagcttttactctttttacataattactatacacagctttttgagaaggtgtcatttcaactaataaagttttttctattttatctggtaattcattcattacttctttcttagttctccttaaaataaaaggctttatcatagtcttaagattctctaaattctcttcccttcttgaaataaatttttcctcaaacttttctttagcatagaggtagcctggcattataaagtcaaatatagaccaaagctctgttaaattattttcaataggtgttccagttaaagcaaatctaatttttgcctgaatttcttttacagctcttgaattctgcgcttccgaattcttaatgctctgaccctcatcaattatgcaataatcaaaaacaatatctctataattatctatatctaatctcaatgttccataggtagttagcactacatcatattcacatatatcttccatcactttatctctttgacttccatgaatcatcacaactcttaaacttggcgcaaatcttaaaaattcatctttccaattataaagcaatgatgtcggacaaattatgcaagtctttttgttcttctctgataataataatgctataacttgtattgtcttacctaatcccatctcatctgctaatattcctccaaatcccacttcacttaaggtcttgagccacttaaatccattaatttgatattctctaaggattcctttaaaatcacttgggattgatatatttttattatttatgttgtctaacttattttctatatcatctaattcattcgaattttctatactccctaaacctatattcttcatattttcatatagacataaggctttattcttttcgattttaactttttcattatttgaatccagatttatatttaacacttcaattagattaaaaaaacttctcacaccattatcttcaaaatctaaaaagttattatttcttgttttgtaaaatttatttttatctttatatgcctctaatgcactatttaattcctttgttcctaactcccctatactataaaagaaattataacttccgtccacttcatctaaatcaactctaattgaatccagatcatatatttttttattgctaaggccgtttcctaacataacatttcccaaggagtggattgtctctccttttttgcttagtatattaaacaactcttcatctttacctataaatacaagtctgttatccatttttacaaaacttagtttttcaacttccataagaagcttttcttcttttttatcatctcttatgaacgtatgcgaaacatttctctcatctaatatattgatttttgtattaccatagctaagaaatatatcacaataaatttttccgttcccttcatataaaaagaattcaggtcttgataaattagatgcataatttcttaagttttccgcaatatttatgttactcgaaattctacttaaaagagacattagtttagtgtaagtatctatatcttttttataggtaattctgccatgaactaataatctttcatgcagactagcataattatcaatttgattttttgaaggtaaatagagttcattcctaaaataataaacatcattgtttgaatttagtggaatgggaagctgcttatgagtggtcaagactatcattccgttatcttccttaacattaaaggttataggtaggtctttgtgtaatattggtgctgtaatttcaatataatcaaacttaaattttatttttctatcctctataccttttaaaaattttctaagttcctctggcttaagtataagctttccacttctcgaaggtgtttgtacctcataatatagagaatctttttctattttacgaataagccttgtgctatgattatttccccatattttatatttttctgcagctttcttttcagaattttcttctctattgttatcattttcaagtaagctaataaatttatattcagtagcagttatatgactacacattaatgtatatccacttgaagtaaattctttaaactcattacaagaacagttagcactctctagttttttcttctgaagattaattttaatatgtgtactaaattcgttaattttatttttatccgtaacttttccataaatatgatatatgttatctatctttttccccttaaaataagtgattaaaccattattaaatttaacctctccctctcttttcatagtagatgaagctgatttaaataatattgactttaattcttctagtttcaaataatcacctctttcatgacaagcacaaataaaattctagccatttatttaatctataaattataaattaaatatcacttttacatctaatcgttgcattccaataatgctatttttacataaaatatattatagcatagtagtttagattttttatcaaatagtacttgaccaactttcacttaaagtaattaattggttttgatgtaaatatttatattgacatatttaatctacaattgtaaactgaaatagtgattacaattgtagattaaaaaatgaaaggagttttttaatgaaaatctttcctaaaatatcagagtcagaatgggaagttatgaaacttatatggaaaacaaatcctttaacttctgagcaaataatcaattcattatcagataaaatgaattggtcaacgcaaactataaaaacctttataactagacttatcaaaaaaggtgcaataggttttgaaaaatcaggaagaatttataattactatccattaatttctgaaaatgaatgcataaaatctgaaaatgaaacatttctaaaaaaggtctatgatggagcattaggcatccttttcactaaatttttagaagaaaaaaatttatctaatgatgaaatcgaagaactcgaaaaccttcttaaaaataaaaaagaaaaaaactctaataaagataagtaacaaatatgattaagatattttaaagaagatactaagctacagaacacgtatattttttaaatattaatattcatatttagtatggtaaagcctataaaattaaactttatatttaaaaattcaaattacatggaggtgatatttttgtggaaatcttagaaaagatttttttatttactttacaaatttctttatcagctagtatttctgcactattgatcattttaattttaaaattatttaataaatatattggcataagagttaagaatatattgcttattttattacttataaggtttcttgtgcctattactccggacatgaatactaatttccttaatactttatatcaaaaatgtgaaaacactctaaatctatccaagggtaatactaacttggaactagcaaaatttgattcagaagttcctaagaaaagcatagaaaataacatctataacgaaaaaactcaaatagagacagaagataaaactcaaagcactaataaacaaaattctattttaaaaataatctcatgcatttggataataggtgtattaatcatagatctgatattatttttatctatgcttatttttaagcgcaaaactaagcatttagagacagatatgtatcccgaaattcaatcagtaatagaattatgtaaagataaagctaatgtaagttctaatatttccttttacgtatgtgatgaccttaatagtccttgtatattaggaattacaaaacctaagatttatcttcctaaacatattttaaatataaatgataataatctactttcacatatatttttgcatgaattattccattataaaagaaaagatttattatgtaactttttgagcacaattatattttcaatacattggtttaatcctattgtttggttccttcttaataaaataaaactttatagagaatatgcctgtgatgcttgcgttcttgaattactaggagaaaaagaagcaataaagtatggtatgagcctaataaatctttcaaaaatgtttttaaataaaactaaccactctaatttagcaattttttttgaaacaaacaatcaaatgaaaggacgaattgaaatgataaaaaaatttaaaactggttcttatagaatctcaataattggtgtattaggttgtgtattaatcacagtcatcatgcttaccaatagcataaatgttaacgctttagatattaacaccaataaattagctactgagagcagtacagcaataaatactccccctaaatttattgttgatacacctgaaaaatcttactatgatatagaaaaagtagaaaaagtagctggattcaaatttaaactacctgattctcctcagcttagtagagctagcagccttcaacttataaaactttctgatcaagataatgttttacttatatacttagatggtgatactaagtttacatttcaagtttctgaaaaagacccactagaatatttgaagaaaatagctactgtaaaaggtggatcaaaaaattatattgaaagtaaagaagaatccatgaagctaggagatatagacggattcaatgtaattttaactcaaatatccccttctcaaactttaaaaaatggtgatgtaatacctgaacgaaaagatgtagataaatatttcgcatggaaaaatgaaggattatggtatagtataagatataattcaccatcgaaaagttcaggaaaaaacgctaatcaaggatctaatatttcgcaaaataatatagaaacaatagcgaaatctatagtatatccagacgaaataaagaacgtaaaatattctgtagaaaaagattccccttcaacagaaattgctacaatgatgatttatgacaaagaagatttggaatctgcaaaaaaatacctaggctttaaccctaaatttccgttaaaaataaatgaagatataactattaatcagtcagcagtaggaatttcagacaactcagatataaaaaacaataatattagctatgaacttgataacatatatagaaataagaacggttcaataactttcaaccagaaaaaagcttcaaaagagtatgaagatatgaaaaaaagtggatataccactatatacaataacgaaaataataaaactgaacaaatcaaagttcaaaaattaactataaataataatgacgtatttaaatacttatatgatgaaaactatcctgatggcacttctggcagcaatggagaatatttttggaaggaaaataatatttactactctgtatgtttttttggcaacactgctaattcagatgaaatagccaaagaatttattacttctaatcctatagattagaatataatttccttactttcaaaaatatatatcagtatctcctatcatatttttattacaaaaaataaatagtttaaaaggtattgtgttaattcaatacctttttaactatgcattatttctcccttttttgtcgtataaaaatatattagcttattacgagtataataagctatgttaataatactttcaatataaaattatatgccgcctcatcttcccactgagataacttaacatgacctaaattaactccatcaattttaaaatttaaaatctcttttaggttattgtaatataattctctattcaacttgattttgctaaataaaatcttttgaacacatggtttactattcgcatctgagggaagcatcatcatagcaactccaccagtatacttatttttatttaggtttggtttaatcatatttatatatgtaaccccatcatttgagctgcttaaattaaaaaatatcattttatcggatacaatatacttccccgtaaaatatttaattaccttgtcatctgaacaaatcttaaaatttacattttcattcttaatttctatgattccttcatgcaaagacccttctttagctatattagtaacaaaaaaataaacatagtatttctcttcaaaaatataggatccaatttcattattattttctaagttctcaatatcttctgctgttagcggtatagaaataagcttttcaattgttatattatatacttcagaaatatatagtaatgtttctatagatgggaaagcatctcctgatttgtatttagataataaatcctcagatataccaattttaccagccaactttttttgtgttgattccagttgaattaattttcttagattgtacgtaaaaaccttagatgtcttttcatatatatcattttttaatgcttttacttcattaatattgttatacataatatctgaatcagctttaatataatttaatttcttctttatcttttcatttatttctttaaattcatataaatctttattcaaattcctcactccatattgttatcatattatgataatcaagtaagttgaatcatattcaactgaatattttatatttttcaattatcttagacatttatatatagtaattgaaacaattcacttactatattaccataatattgcaaacttcaaaatacaatatattttaaggagatatttatgtctagatcaatatctaaaaatgctttttttaaagcagtattaaatgtttcaaatataattttacctataatagttatgccaatagttcttagtgcaattcaagataaattaaatggatatatgaccatgggggaaacctggactgcagtttttatgattttcgcaagctttggagtttatcaatatggtttaagagaagtaagcaaagtaagagatgataaggataaactaaccaaaacaattactagtctatttgtaattaccaccacaacaacagctgtaacttctattttttatgctatctttttaactatattccatagaaatgatgcatatttttatacttgcatggttatgggattaaacatagtctttaatatgttcaatgttgaatggatcaatgaagctcttgaaaattatgattttatagcattaaaaactatgataattaaaataatatataatttattaacaatatattttgtaaagactcaggctgattttttattttacatatatcttacttgcggtataaattttattaataacatatccagttttatatatataaaaaagatgatacactttgacttctcagatttacaaataaaaaaacatataaaacctatgttttcagttgtaatacttgctaacacatacattttatatacttggcttgataaaaacatgctaaatagcaatttaggatcaacagaagcaggatattatggagtcgcccaaaagataatgtcaatgatagatatcttaatgtttacaatagttcaagtttccatggctagactttcaaactatttagaaaatcattcaaaagaagtctatttaaatttattaaataaggtaattaaaatatatttcctgttcttatttccagcctcaataggattacttggagtttctaaacaagttatcataattatgggcaaaggtactgatatatatcttccagccgtaccaatactaatggtgttttcagtatatatgctgactattggaattgatagaattatttcagatcagataatttatattttcgggagagaaaaaacagacgctaagttagttttcattggagggatattaaatttaatcttgaatgctcttttaatatttaccaatatgttcacaccaacaaaagtaatcgcaacaactttagtttcaaatttagtagttatggctttagaatatagattagtaaaaaatgaacttaacataaatataaaattatttgcttttgagaattttaagtatttatgttactctttaatattcatcccaataacctttgttataaataattttatatctggaactatattatcctgtatccttgatatacttgcttgctgcagtatttactttataattcttatagcaataagagataaggtattccttggattattaagcatagtctttaaaaaattaaaagtgttatataatcacagaataatatagatctttctagttaattagaatggatataaaaaatggtgtattgtagtctcttttcaaatagaagaaacagtaaatagtttatttttattaaaaactatttactgttctaaattttacaaaaaacttaatatattcaatttcaattaaacctcaaaataaattattagcctaataacattttttcatcaatacgtttaaataattattatagaatttttacgcaaccaacttattaacaattatttttattacagattatttattaattctcttgcttccaagtttcatatgaaattgaggatcttttggtatactcggattaacacctcttaaattaggtatctctccacatattaattgcattggcactatgaaattaaatgtttgatgatgttcatcttcactcacatttatttgtagatttctatcatccgaagcaacatttcttcctattacataaatattgcttgtccattcagataaaacttcaatcatttttgctactcttggttcttttcctgtatctaatataaatattgttgaatcactatttattgcattatatataccatgtataaattcttcaaattcatatcctgtaacaggcactctcatagtttctaataacttcaatgcactttctaaagtatcaccatataattctgctggacctattattcttatttccttagcttctactaatctacttttatttttctcaatccattgttctgactttttatatacgtcttcaaatctatcgctagcatctaatattttatctatttcttctttgtatttttcttcagatatttgtccattttcttttcctaatttaagtccaagaagcattaagtttaactttgtgcaataaaaacctttagttttagctccagctttttcttctccacagtatactgttaaaatataatctgcagcctcatctattaaagcattttcgcatccagccatagatgcagttatacaaccacattcctttgccaatttcattgcattataagtcgaataactacttccgccttgtgatatccctattatcaatgtcttttcgtttttacctttgaatgtatctttagttatcataaatggatacattgctataacttcagcatctaatattccttgcaaataagtttgtacttgtacccctgaatgataacttgttcctgatcctgtaattataattttatctatatcttcctttattatttctttaaataattcatcagattttgagactatctccttcattttagttggagtttctaacatataatcttgtattctcatttttattacctctttctcttattttttattataatagccatattgcatgcaatattattccaccaactataacacctattgttattttagtgatgcttactttcttctttaatagatagtaaataaagaaggcaaataatagtggcagcatgtttggcaatattttatctaatatatcctgaactactacttttgcaccgtttaaattaaataccaacggagtttttatttttaacatagtagataccattccaccaacaacaaataatccaactgttgttgctatagacattattttttccattaatccttgcttttgtatcttctctaatgagttaactcctaattggtacccatattttaatcccaatattctaatagcaaaacctggtacattatataatagtaagaatagtattggtccaaatatattcccttcactggctagagaaacacctattcctgctgctataattctaaatgtcccccaaaagagcgaatctcctattcctgctaaaggccccattaaagcagtctttattgcactaatcgcgctttcatcaaaatcggaattatttgaattttgttcttccattgcagcagtaattcctagtattgtcggaacaattactggggttgtattaaatatctcaagatgtctttctagagctttagcttgatcttctttctttgaataaagttttttaataactggtaacattgcataacaatagcctaaattctgcattctttcatagttaaatgctccttgaagagcgaatgaacgccaaaatacacttcttaactcttttttacctagcttattcaaagtcaatctccccttccgttaaattacttgcaactgcctgcttagctgtgctattttctttagtgttaatataaatatttaatataaatgcaacacatgctccaaataaagctattgctgttatatctaatttagcgtaggctgctaataaaaatcctatgaagaaaaatacagccattttctttgaaagtaacatatccattaatagtgcaaatcctacagccggtaataatgatcctgctattccaagcccttctaaaattatctttggaatggaatttatcaatgctgtaacagcatttgcccctaacataattgctaaaaatgttggaataaaagtgcttaggaaaaataacataaccggaatccacatcattattgcaatacccctgaagtcagcctttttagcatatacacttgccctttgagcaaaataagaatttattattcttactaatactcctaatgattgtgctaaaactgcaattggtactgctatagcaagagctacctcaacaccatttccagataatattgcaaaagctgttcctaatataccacctgttacaacatctggtggtgttgctgcgcctattcctgcaatacccatccatataagttcaagttgagctcctataataatacctgtttttaaatcgcctaaaattagtcctactaaggcacctgtgattattggtctttcaagcattatctgcccaaaaatacgtccatccagtatacctattcctgcaagtaatcccagcataattgcttgtgctatcataattttttacctccttacttattttagtaaatctgataaagtctttttcttatcccttggcagcattctaaattcaatttctatgcctaaatcatttatttcttttaaattagatacatcattttcatcaactgctactaaatctgttagcttctgctttccagcttcatatctcaagccccctacatttaactcttttatagctccgcctgaattttttactaattccaatgcatcttttgtatttttcactaaaacaagtacattattctttttagattgagcaaatttctctactatctcacctgattcctgtactcccctaatatacaaagttacattgtttggtttagctaagtttaatgccatggccttcatttgatcattttttgcttcgtcattaactactaatattacatttattcctaatgatgttgaccatccaaatgcaacctgaccatgtattaatctgtcgtcaattctcatcaatgatatcatcttcttcattcctttcattattgttttttagtaattcatttacatgaataattcctttttttgattcttctattccgttctttaccaatgtttctatatcctcttcatctgataatagtattgttaaaatcattggcaaatttatacctgttattaattcaaattcatatccatttagcaataaattggtacataaattagctacacttccaccaaaaatgtctgttaaaacaatataattttcttcttcgcttttattagataaaattcttttcatttccttttctgcatcatctcccgatttatctttagtcatgcagaaatattcaacattgcttaatgatcctactattaatttactagtttctataaattcttttgatagttctccatgagttgcaattagaaatttcttcattaccatcacctcctttgtttttttatttataccttattaataagcaaaaagcatgccaactagtgacatgctttttataaaactttattgtattctcttaatcgcttgaaatcattgaattggtccatatattatattatagatatatccaatctctgcaattggtatttgcacactataacttttttctatcacactaaatgaatttttaattagcttaatctcactctgatgctcttcaattaacaaatttaaatctgtatattcttctatctcagcctgtcttactagtctctctaccatacaacttaaatgaacatataaagcaatttttttgtcatttggtatttttcttttctgattattttcaaactcattaataccgtcctctattctctctataatcttattagaatctaaaatagtcaggctatctataactcttgtcaaagagaagtttttcacaatagaatcatttattaatttaatttggtcatgtcctgctaccttactgaaaattctgtacacctcatcttctctttttcctgatataatatcttctaaagatataaacttaattgtctcaatttcaggattatacgtaccaacaatagctaatacgtcatacatcttgaatatagagtcatcttttcctttagacactagattattataactatacggaaccacctttacatcaactattcctgctaaactttctgaaagtaaattctgtatcttaattgcagtacttattcctgtaaaacaagatgctattattgcatattctttattcttttgaggataaaataactgtatgttaggtttaatttcttcattcattacttcagagatttcttcaatagtttttccttgtattaataaatttcctacttctaaagctaacacagttgtaacttgatctatacaaagcattggaatattaatcttatcttttaaattttcataaattaagctaagagagcccatatcaaataaaacaattaagccattttttaatttatcatcttcaatatacctgttcaattgcttaagtacatctattgctgttgcatctattggcatatcaatagatgcaaatacatttacacctataatacgattgcagacattagccatactacttgcagttgcatatccatgagcaacaattattgcattcattttattaaaatttatacgtattgcggtagttttaatgaatataatcataataattaaatcactatcagttaaataaatatccaacctatttgctataaaacttgctatcttatacactatagagtattctttatagttttctctctttaaatagctcaataaattattctctatttttaacgcctcttcatttaagctataaaaatcattttttgagtataggtatgatgaaaaagccaacacattattcccatcgtatttaatattataatttatttctagatttctaaatatatcttgcattgttgatattataaattctataattacgtttttagtttcatcattattagcaaatactagcctatccatcaaatttaccattatattggaactcttctcataaaatccttctttgctgacttctccattttcaactaatttatacaacttaaaacactctaatatactttgcttaattatgctttgcttactctcttcatatgtttgaacatgtatattgctattgtctgaaaatacaatacttttgcttttattattgttttgaaacttaaaaatttctgcattctcaatgtatatatttcttggtatatcctgcaatgttacaaatatattcccatttcttctttggccctttgaatatgctcttccacacgcatattttattacattcttacattctccaatatttcctttaaactttatttttagaattgtatttagtgtaagctgtgtaatttcaattggtattccaaaaatcttactttcttcatatataaaatgttctattattctccttttctcgataggtcccctttcctctacattagggatatatatattaataggtattcttcttaaaaaagttggcaaaaattcagatagattttctgttgttgcaaaaactaatcgtacatctgcttttctctttacgccattctcaccaattcttgaaaatactcctgtatccataaatgtgaacaatttttcttgtccttcgctattaagtctatgtacttcatctagaaataagattccgccatctgattgttcaattaaccctgcttttgattctgtagcccccgtatatgcccctttagcatgcccaaataatataccagataataattcaggattattataatactgagcacaattcaaaacattatatggtccatctttttctaaaacattacagcttacactgtacttgtagattatctctgctaaaaagcttttaccaactccactttcacctgtaagcataacagttaatccccctttgggatataaaactgccgttttgatttgctcaatgacttccttcagactgttatcatagccaattatattttcaaaaataatctcctgttttaatgacttacattcctgttctagctcgtatatatctttatatatactcttctttgttggcccaataatatcattaattttttttctaggaagaaatttaactggacgattatttatcttaattaaatcgttagatttcaccaattcatttagtaatctacttgcttgagttctgctcatcttaaaagtgctagctatatattcagtctcaattcctccatacttttctaattccttaaagctctcaaatacagcttcagagctaataaattctaaaactttagtaatcataaattccctcccgtacatataaaaatttattttaaactagtatactaagaaacatttccctctaaaatttttatctcatctcagcaaattatttatataattttatcacattgttagtaaaactcaatcatatttaacatattttattttttgcgcacctttatttttcctttatcaaaactcaccctttatttttatatatttaatatatttaatatattacaaatatcatactaagttttataaataaaacaactatctgtactataactaattcaaaaaatgacaatgcacattaactatttgtctaaaaaaatatttaatgatatgataactttaaaattacttacctagtttccttaaaataaataactctaaaattgtttataattctttatgatttaaaatgaaggagaaatgcctaatgatagacttacacattcatacaaataattctgatggagattttgatgtaatagacatcttaaaaatgtcggaagaaaagaatttagaatttatttcatttacagaccatcaatctgttgatgcatataaaaaaattagcaacttaaatataaaggatttatacggtggtaacataattaatggaattgaaatcgctttttcatttggcggaatcagcatggatatgctaggatataatattgatattgattctatagaaaaatcaagaatattacaagttaataaaaatattaatgttattgaaaaagaaaattctaaattaaattatttaataaatgtttgtaatgaactaaaaattctacattcctctaatttaaatataaatggcagaaatactcctgctaacgatgttatttgcgatgatattttaagctatgatgaaaatttgcatattctaaaaaaattagaaattactgatagaactactttttatagaaaacactatttaaaccctaatagtcaattttatataaagccaacagaagatcttccaaatatctatgaagctgcagaaaccattcatagttcaggcggtaaatgttttttagctcatccttatgtatatgacgtagataacatatataattatatcgacagtattgtcaaattaaacttaatagatggtattgaatgcatacatcgtaagcattctcactcacaaataaatgaaataattaattattgtgacagccatgacctgttaaaaagcggaggcagtgattttcatacttcagctcatacattaggatttggaaatgaaggtaaaataccaattaattatcccatagctaaaaactggctacaataattcattcatatttatttagctttaataatatattgtgaactcccttttattatataccttgagtttcgcttaataagaatgcagataaagtgaacccttttaagtaaatcctcttctagcattttcagctttctctacttaattgggttcacttcataataatagttcttataattttcatataaatatatttttttattttataattatctcttttcctttataggctttccatatccatatgcaccttcaatcatgcaaatatctgccgaataattacttgccttttcaaatgcactaagtatttcattttcagttaatttattattatctttccacccaaatcttaacaaagtgacaataaatgccgcgatgaacgaatctcctgctcccattgtatccactggattaactaactttacctttccattatagtatttatcgccatcaaaaaatacttgtccattttttcccatagttactaagacatacttacatccaaaatcatgaatcttcttttgaaatatttttatctcatttatattcatattctcacatgaaaataaagctaaatctatatatggacatgtcttctgcaaatagtcatctgttctatacttatctttggtagaaaaatcaaaagttattattgaatctatcgcttttaacttatatacttgatcttctaactttgcattacaactactatgtatgagatcaaattcagctaaatactctaactcatccttttcaattcttataggcttaggccaatttgctcctatatcaacatttaatagatctctctccccatcgattatatttatatcacacctttttgtggttccattttccaactttctacattttgatatatcaacccctaaatcttctaaggaatattttattaactctgcttcctcatcatccccaaatactcctagatacgcagaatcaacttcacattttttcgcatttactgcaaaatttattgcatttcctcctggatacatcatgttcttattcatatatctatctattacgttgtctcccagtccaataactttcataatattatttcctcactttcaaaaagaggttatcctaaaagttaattttaggataaccattattattatttttaatattcaacctttctgtagtaacgtcttatttctaatgagtgattacgtattacttctaggtgcgcacttatccttcctagtattgcccacattactactggagataataatttcctatattcttcacttattcctggtagttcataatcctttgtatcaaatactgtaaatttatcagtataatcaactaagaacttttctactctgtcatctaatggtctagtttctgcctctgtttttaataaagttgcacacacatctttttcaattagttctatagttccatgaaaaaattctggtgaacttacagatttagttctcaaccattgggattcttctaatacacacattgagtatgaataagtagttccccaaaggtttccagacccaatccaaatttgatatggatcatttttatatttttctgcatattctcttgctttttcatcgcttgcttttctaacatggttcaatgcagctggtaagctttgtagctcttctgcaaacttattataatccgtaaattcgtgattgttatttaataacttaccaattaatatatatagaattaattcttgtggtctaccatccttgtatactactgaatatgttgatagttcttctaggatagaattctctttcccaattatagaaatagtagtaactcccttttcctttaaatactttgctgcttcaacagtctcttttgtatcccctgacttggatgctaaaaaagctattgatttatcagttatttgagaatttcctgttaataataattctgctgatatttctgagtatacaggaatcttagattttgttttaatcatatattcaaatggttgcatcattgctatagatccaccagatgatgtaaataatatattttcaaatcctttttctgttagcttgtctgctatttcttcaatagcctcccttttactatagatatattctccattttctagcatctttttttcatcaaatttaatcataatatcctcctaatttttatatattgatatctacgtaataaatatttatataattgcatctctaatattaagctgcaaatattcctaaaaatgtgcctaatatgcctaatgccattaatcctattagtatatatataacttttaatttcctctgcaataatgagtaaattatagtagtaagcccaagaggaagaatatatggcattattccatctattatcttctgtatttcaacagcactatctccagttcccatcattccagcaattttaatgttcaccattccaggtatcattgctcctattataattaatccaattattgaagccccatatgttaacttaggcattaatccagagtcttctattttttcaagaaacttcgttccaaatttatatccacttatcatacagacatatctaacaataaattgtggtatattaaataatagtaaaaacaatattggtcctaaaatatttccttgtaatgataatgatgttccaactcctgtagctattacccttaatgttccccaaaaaagcgaatctcctattcctgctaagggactcattagagatgcctttacgctgcttattgaagatgtatcaaaatcttcattatttgcgttactctcctccattgctgtagatatccctaatactaaagttgatacatatggtgttgtattgaagaattccatatgcctttttacggcctctatttgctcttcttttttcttataaagtttcttaataatcggcagcatagcatagcaataccccatattttgttggcgttcataattccatgaatattctaaagcaaggcctctcaaaaacatcttcttaagatcatttttagtaactttaacatcatttgattgttctaaattattagaaatcttcatctagcattacctcctgtttctttacattattgttttgtaatcccacaagaactatcgcaatgatagttgcaaaaattgcaacacctagcataggtatttttaaatatgcactaattgcaaatcctaatacaaagaatataaccaatttttttgtcaaaatcatttgtgctagaagtgatattcctaaagctggaataaatcctgctgcaactactagcccattttgtacaaattgtggaatgctatctagaacggcgctcataaatgggcttcctaaatataatgctagtgcaacaaaaattcctcttggtaagctctttactacaaatccccctaaaaagtgcatcctacttacaccgttgaaatttccctcttctacatatttatctgctttatgaagaaaaaatggcattacaaaaagtgtcataacattatcaactaatagaaatagcgttgctattggaaatgccaatgtcaatgcaacttctgctccttgccctgttgctatcgcaaaagctgtacctaagatccctcctgttataacatctggtggaactgctgcacctaatgtaactgctccaataaatgccatttcaagagttgctcccattataatacctgtttgtaaatcgcccataactaatcctacaagtactcctgttactattggccttgttattaagcatgatcctaaacaccattcaaacgtaacaaacattgcaatcaatcctactaaaatagcttgagtcatacaattttacctccttataatacgtttttaactaaaattttcttatcacctggaacctgtcttatctctaattcaatatctctatttattagttcttgtaatattctttcctcctcctttgatattggaactgatttagtgattgttcttgtcccttctctaggcataacacctcctatattaattgattttatatcaggcaattcattgcttaattttgctgcatcttctattgtttctactataatgaataacttatatttatctgtaactccactttttatagccgcaatggaatcctctatattcttaattactaatttaaccccattaggtttagccaactttattgttgtcttctttatctcatcttgcataagtttatcatttgcaattaatatacaatctgtgttaatttgttgagtccatgctaatgccacttgtccatgtaacaaacgatagtctactcttaatagtttaatcatataaaatcactcctttaaaattcttcgtctctaattgatttagccgtatgaaatgttttattacaatatcttatattctcttgcgtatttttaattgtttcttcgattaatttttctgtactctcttcttggcttgttattaattcaattacaagtggtaaacacatactcgaaataatgtgtaagttttcataattaatgtatttcataaactcattatttacacttcctccgaagatatccgttattactattaactcttccccatcttctaaattatttatgacctcctttacttgttggcttaaatttttttcgctgcttatgtatgcacaaagtgttgatatattatcttgttttcctattattatctttacagattcatgcattccatctgcaagtcttccgtgacttgctaataaaaatcttctcttcaaaatttatcatctccatccaaactcatgatattataaatcttatttcacttctcatagcattataaaagcaagaagcgtgccaatgtctggcacgcttctttattcttcactatctctatcacttaaaactcagtattttcagtactttgatacatcaaaatatcataaataaatcctatctctggtagattaattttgacattatatattttttcaatgacactaaatgaattttctatagtttttatcatatctttttgacactctataaagttttctaagtttggatatgcatctatttcttcgtgccttatcagtctttctactaaacaacttatgtgaactaataaagcaatttttttctcattatttaatttctttttcatagctatttctaagttatctaagcattcctctatatttcttagcaatttatctgtgtctaatatagttaatgtatctattacccttcttaatgtaaaattgtgaactatattatcattaatagttttcaagtcattttcatcagctattttttggagtatacgtcttaattgattttcccctcttccagacattaaatcttctaaggaaatataattaatatgtttaatttccggatctgcagtacctactatagttaaaacatcatacaattggaataatgcttcattcattccaaaagtttttagcctctcatagtcatgtgctatgaccttaatcttaagtttttctgggatactgtcctgcaataacttctgaagttgtaacgcagttcccatcccagtaaaacaagaagttacgattacctttttcttattttcttcagggtatagaattttataacttgtttcattatgttcttttagattttccacaagttcttcaagatagattttattttttaacatttcaccaacaaatagcgccatttgagtagacacattattaataattactactggaccatttatataactatttatgcttttatatatatcatttagcgaacccatatcaacaagtattaccaatcctttagatacatcattttcttcaataaaatttattaacttttttgctatttcatccatttttatatcaataggcatatcaaaagcttcaaacatattcatttctaacattctatttgctacatttgcaatactactagctgttgcataaccatgagccaaaattacagttttagttccgttattagattgctgaatgtttaagcttttcaaataaaaagataaaaaaatcttatcatctatcgtaaacttaatatccatcttgctctcaataagcttaattaatttaattgcaatctcatgttctagcttattgttttttaaaatatagttatacaaactatctcttaattttctttgttcctcattccattctaatgaatcttcactctttatatataaaaaatatgatattgcataaacgctattaccattaaattttatattataatttatctccatgtatctaaatatctcttgaatactcgctgttatgtattgaatcataacatttttattttcttcttttctttcaaatattaatttatcaaacaaagcatatacttcttgaaaaacattagtctcaaaatactcaatgcttacatttttcttttgaatatcattaaaaaaactcattatttgaatataagtattctttattagttgctgccaattcccatctttttttaatatcattggtacagtagtatctggtaaaattaatatatattcactttgttttatctttatatcagatttcttaattgagtcttccaacaactcttctggaaaatccaatacccctaactgtatcatttctgaatttatttttttagtataagatttagcacatacatatttaactgtgttttgcagttcacctatattccctttaaagctataattcaacattagatctatagccctatttgaaattgaaatctttttatttaatattttcgcttcttttattaaaaattgatatataaattgaagtttttcatcggtgccacgcttatctagatctggtattgagactgatataggaattcttcttaaaaaagttctcaaaaaattttctgatagtgattctgttgtagcaaaaactagtctaacgtttgctttatgccatcctgagctttcacccattcttctaaaaaccccttgatccataaatgtgaataacttctcttgtccttcctcgtttagtctatgcacttcatctaaaaagagtattcctccatcagcttccttaagcatcccttcttttacgctttctgccccagtgaaggcaccttttatatatccaaaaagatttgccgataataattcagggttattataatattgagcacaattaaatacaataaatggggaatcttttgatattacttgtttttctaccgaataattatatatatactttgctaaaagacttttaccaactccagttggcccactaagtataatcggtaatccgttattaggataaaatatagatgtttttatttgttctaacgctttttctagacttcctttaaatccaattagctctgaaaacttgtccttttcttcatctaatggtttttgaaaaaataattcttcaatgctattatatttgttgccttttattccaaaaaaacacttttcaaattgactataatgcaaaaaataaacaggtcttgtattaatttttattatcttaccttcgtcaaccatttgatttaaataatggcttacagtatttctcttaacatcaaacttctttgcaatttcgctagctgtaaacctagaattatcaccagctcttccaaagtagcatgtttgctcttccaaatatcccattatatagtctaacaacatatttatcacccttatatattatttttgagaaatgaaacaagagtatataaataaaaaacttttttatattatactatatttttctacattagaactatatcttaactttatatttaaatatttttacatgacctgtactttccttttttataacttacaagaaatatatagtctcaagaataattaagtactcttttacagatatttctatattaaatgcttcttccattggttttaatatttctctaacaaaattatatttatctttattctcatctaacattttctcactatacttacgatatataattttttcgccactcaacatacgctctattacacatgcaatgtgtaatattaaccctattaatgcagaactattaagttcaactttattatttacaagacgtatgtaaaagctcctaaaacactcgatatacttatatgaatctatatttacattttctccaattacttctctcatatcatatatctcttctattagacttaatcgtgattttagtagttctacttttttcttatcaaaaatatctgatgttgatatatacaacaaagactcatcatctggttttaccgcacttaccactgccaatatatccttttctgcctttattttttgtatattatgattgaattttttcttgtttactatgtctatattaagtatgtcgatgtcattgctagtgatttctagtttcttttccacaattggcttgagttttatagcagttccttgtcctgtgatgcaagctgttataattactttctttttaagtgttgaatttatactaaaattatctgcataacttcgcactatatgtggattcaaatttatgcagcaatcataaatttcctccaatgaggcttttaatgttgcttttcttgtagcttcaagaacaataggtgtagacaccatttctattgtttttaccggtacctttgtcttttcgtaaatcatatcaccaaataaaacaagagatcccatatctactaacagcaatactcctctacctttatctatttcttttactatttctgttaaattctctagtgcagtctctggtttctgatccaatggcatatcatagcctatagcatatttctcacccaaaagtctattagctacatcagccattgaacttgctgtatactctccgtgcatagcaacaataattccaacactactctcattttcataatcctctttatctatacataaaaacatagttataaatccaacttcatcttctggaattctaatatgaaatgtgctttcaactttttctttcaaatcatacgaaatttcatattccctggaatgcatctttttaatatcttcaagctgatgatttttaatttcttttccatttaaaattctttcaactgtacttgctacatgcattgatagtccatataaaattttactatcaaactgcattaacaatttttcactagccttatttaaaaattcactaactagatctacaatttttctatcaactactttatataattcttctaaactatccttatctatattcagtatatattttttaaaatacgtatctatatcaagactcattataagttttatgtccttttcacttattccattagactccaaaagttttcttttttcttctaatgctccataaaaatcaactatttttatatcttcttcttctcttacattattttcatccaaacaaaactttataacatcttgatttacaaacctatcaatttcacttcttttctctttatacttaaataatccgctaagtacatactgaggcaagtattgactatgaatgcatatattcttatctcttttcatcatattctcaagaaaagcttttgagcagcttagttttatatcgcttttgagttgcccaatattattagaacaattgtatagtaaaaatgcttttagcgcatttgctgtaatacttatgctctgcttaatgcaactcacttctatctttaaaaagtttttaataagttcgtatctttcttctatagtcctatcttttaatgctggtaaccgtataatcataggaatccttctagtaaatgttttcaataatgccgattcaacattttcagtagtagcacatattataagtagtttaactttatactcttcctcagaatctccaagtctcctatatatgcccttatcaattatagaaaatagcatttcttgaccttccgatggtaatctatgaacctcatccaaaaataatattccttcattagctttttcaactaatcctatggtatctctgctagcaccagtatatgcccctttcttaacaccaaagatgtgactcactagtagctgtggattatttgcataatctgcacagttaaatgaaataaatggcgcattggcttttattttgccaatttctttagcatacttatacataacttctgcaaacattgattttcctgtaccagtttcccctaaaagaagagtatgaagtccattgggaggatatattatagcagctctggcctgttgtgatgcgtttttcagactgaagctagttccaatgatgttatcaaaagcatcttttaaaactttttctgtgccttgccctatctgaatatcctcctcctttattttatatagtaccggcttcttcaatatcttttctatttttccatctctataaagtttatttaaatcactagatacgtttgtcctttgaatattcattattaatgaaatttctgtagctgaaaaaccgttgatgcatctacgttcattatattccttactacacagatcccttagaactttataaatattatcaatccttctcattgcttttcccctcatatcctattcgtataactctcttaacgttaacactctaggtacgtaaattaaatttaaatatctttaactaataagcttattatacatgatttaccatagaatttgaataaacatatcaaagagtggattattcaagttttattaaataacccactccatttttactatttgctgtttttacttattatacattgcatgctatttctttttctttaaacttttcttcatacattttaataagttcacagataagatctttagctaaagatgcagtcattaaatgatcttctgcatgcatcagtaataaagataattcttgtttattacctgcggcctcttcttgaattaagccagtctgtatattgtgaactaatgaaagttcttctttagcttgtttcatacatagattggctttatcaaactcaccatttctagctaaatttaaagcctcaaaacaagctgatcgtgaattacctgcgtgactaattatagtgaaaactatttcttctaattccatattcattttaaatcctccattatttatccattaagtttagtgcaagttctagaacactttttccatctattcttccataaagttgtactggtatgcaggcataaggcttacctttttcatcaactatttctttaacccatttttctttatatttaacttgaggcccaagtaaaaatacatcataatcatcaacattttcatccaaatcttctactggttcagcattaataactaagtccttgtgacctatttcctctgcatatttttgcatttttgttactagcaaacttgttgacatacctgctgcacacattaataatatcttcatgctaaattcctcctaaatttcattctataaatatttttctaattaatacactaagcttgtactgtatttaaattttcttctttcccttcaatttctaattgttgtttttcagcaaatttaaagaatgggtagtaaattattgctgctataaccatttctacagcagaccaaactgctgctctccaatctccaccagttgcaataaatggtcctataatagggggcattgtccacggaaccatagctactggtctaccaattatgtcaaaatacatcataaaataagacaaagtagtaagtactaaaggtaccactgtaaatggaactagaataactggatttaaaactactggaaaaccaaatatgactggctcgtttatttcaaaacatgcagatggaaatgaaacctttccaagtgatttataaagtttgctctttgaacggatcattaataaaactaaacaaagagttgcacctgttcctcctacattaacaaacaatgagtaaaatcctgatgctgtaatgtatggaatcttttcatgtgctataaaagctgctgtattaacagttaaaaattgaatatatattggatctgctataccttcaagcgtcatgtctccatgaatacctgctgaccaaagtaatgtaactaatgcgctatatattaatattcccggaagagtattaagggcaaaaacaactggactaaatatcatagtaataaaatcagttatattaaatcctataactactcttattagccaaactgtaatcataactacaagagctggtattaacgcaataaatgaatttccaactgctggcggaactccctctggtaatttaataacaatatttctctttacgaaaaatcttaatacttctactgcaaacatacaaactattatagcagtgaaaagtccttctgctccaaatttactagtatctaattgaaaatcctctgtcacttgtgtaagtaaaaatgctacaaaagatattactgatcctgtaattggatctaatttatagcttttagctaagtgatatcctattccaagggctgctaaaacgcctagaactccaaatgatgaatttacaactacattcatctttgggccaagctctccaatataatctgcccaccaatcaaatggaaggttacctaaaataagaaatatacttcctacaataatgaatggaattgtaatagctaatccattacgaattgccattagatgcctttgattaccgactttaactaatggtggtatcatcttttcttgaaaaaaatccataaatctttccataatttcttctcctccataattttttcgttctgttaagctgcataaacatctttcaattctatttaagtagtaatcgcaagcttgctaagtattgaatatctctgctaaagtattaaataatagaactgaagaaaacaaacataaaaattttctatcttacgataagttatataaaactaattttaataaacattatattcaaacaatgtattatgaaagatgaaatccataacttttgcataatattattaatactcaaaaatgaaaataattaaatcacataattatttcagcatactaaagtaatcgtttttatatgttacagtataattttaatatttataaatgtataagacaaatataattgaattattgtttattattactatcacaatataaattttcactcaatatataggcaaaagattacgtttattttttataaaatacaagagatttgaggtttatggtaaataactaagtttgtttattaaatttatgcttaagtaggattaaactaaaattatataatcgctaaatagtaaaatttctatgaagtattaaattatttcttctagcaactcacagaatgaatttatttttacatagaattatataagcaattaccatgccaatactctaaaatactgataaaactcagacttaattgattcagtataaaatcaatacacattttacagttttctaaagatataatacacgtatgtgtattatatcttttctacatttcgtttttcataactaaaaggcttaaaatactgccatatataattaaacgccagtattatgccattaattgattacgtagcctactaacgctttgaatataaatttgttatcacaacatatatgcatacaaaattaatatttaaaagtgcaaaaatctgtataaactaaaaaacaatattaatacttgtccatattaatactgttttttatctttatttatataattttattgcatagctaaaaatctaattactatcctgtttacattaattttagtagctatcacaaattagtataagaaaaacctgttcttaaaccattaattaatactaataaacatcaccatctatattgaaagtatctccataaactgtaaaattaaagtctggtttcaaatctacattacctgcttttaataattttctgtatgcattaactctatccgaaccttctggatcatcatctttaaggaatgcatatctataatccattacactagaaagaaatttattttcatctataccatccttaggtaatccacctaactttttcttagccgaattaatatattcttttgctccatcttctccatgatttacacacatatcatatataaatgctaaagttagttgatgtttagcgccaatggaagttgctagagatactgctggtttccaatacatttcatcaagttcatataattgagctttcttaaataatgaatcattacatgcctttacatcttttataaaattatctaggcctttaatatcatcattttttccatcctcatcatgttcttccttgtctattctatctaatgctggaatatactttgccaaattattattgggatttagcttagtataataatgtattaatatatttccatcgtaagttcctgtagtaaatcctatacatccaaatgtaattcctcgtccatcaaatgagccaagcttctctgcataattataaacaaactttgttttactattttcacatacagtcgttaactgaaggtccactgctttttgttcagaatttgcagtaatggctaatgctgctgaagagaatgagagacacatagtcaaagatactgctaaagtaactaattttcgtaaatttttcatataaaaattccccctaataattattttatctcaattatatataaagcaaatattatgccaattataaaatacaaataatgtatattgaaaacagatgctttatagataaataatacatattatttaatgtgtattctaaaaatacatgtacaatacacataaatgtattaattacataatatgtaaatcgcatataatcttaaaaagtaaaagctttgtattgaattacttgatccttttaaatattaataattcaatacaaagcttaattattatgagaatataattttctaatcttcaaggatagcagctacaatacttgaatttttcaacataaagtttttttatctaaaattaaaacattatcgtaacgttaacacttttgtttacatataataattcatggtaatagttcaagaatatatatcttaagataaaataatattatggaggaaaacaaatgactaaaatatatgaaggagacgctataaatcaatatactggcgtaaaaccaactgaattaatgcaggaatcatcaaatcttttatttagagttcctgtattcctaagccatccaagtagattgaattctattcaacaagaatttgttgatgctataatatctaaaataagagaggctttattatttccacgtaccctaccagtaaccgaacaatatcccgaaactccattaacaaatatcagaagaatgatgctatctagttatggatttatttcacttaatcttaatcaacgacaggtatatataattcaaaataatcttggtcaacctcaaaatcagtttgctcttgagggtagtccttttgctcaaattgaaccagctatggcttatcaatacggtcttcctattcttcttataagagaagctggagtagaacaaagtgggatttggtcatttggtataggtccatttctaattttggagtgggatcctacaaggccacttgaagatttctttacaagcaatgcgtggctagaaatatttcaaaattggatatcacaggtaagaaacggattttatcttcaaactcaacctgaatttaaatattcttgtaataacactgatgtaaggtaaattaaaaatatttcttagtttttatactccatctaaaagatctaaaaaagctgttacatcacaaagaaattctttatgtaacagcttaacttttcttttaactgacattaaaatactttttaaacatgattcttaattataatccttattagccatacaaaacacttccacacactaaaaatccccatgataatttaatctatcatggggattaaacaaatactagtaatatctgaattaacaaaatcaacatatattaattaatatctatttgcttcttattattcttcctctaaaatttcttctacttcttctacactcagccctgtagcttctgcaatttcatcaatttcttcaaagcccattaaatcacgagctaaggaaatcataagctttttcacattttcttcaacacttggagggagctcagacatatcagttaaattttctgttagatcaaaatattcttctccataagactcttcttcttctgcttgctcaaaaagtcttctttttttagctttttctctatcaaattcattaagatatactaacttactattgtttacttctaagtcttcatctgaaaacactgttataccttcattctccaataaaagggctgtaattcccttgccttttactttattacctgtaaaagtaccatcatacacaaagttagatccacatgaaggacttccttcttttaatatagcttttgtggttccaagttcttttgcaatttttaatgtttcatatgcaccatctataaattgcttagtaacatcctcacctttattacttaatgcttttccattcccatctaacacttcacttgctgcactatttagttcaacagggtttcttggagttggtaatccgcctaattgctctggacaaactagaactgcttttccttctctaaataattttaaacatctatcatttagattatttttaccactatatttacaattaactccacacaagcatgcacttattatgtacatattatcacctcttatctaacgtacacttaacactataaaacaaaaacttaagagaaatttaattatagctttacttaattatacattaatatttgtataatattcttactaacaataattttaatgatatttttaacttaaataagtaaaaatattaggtatatgaaaaaaataactaccccttaagttctaccatagtaactccgtctccaccttcaccatatgcacctagcctatatgattttacatgtggatgtctcttaagcatatcatttattgctttacgaagtactccagttcctttaccatgaactattgttacttcccctaaattagccatatatgcatcatctaaatatttatctgctttgtagcacgcttcttctgcatctaatccccttaagtctactctagattctacattacttagattaagctttacttctctttttcttcttactttttcttctttggtaacttgagtttttcttaaatctttaagcttaacatttactttcattattccagcttcaacttgaacttcgcctctgttatctggcatagaaacaataattactttttgatttaatgaaggcaggtaagcttccattccaagagttacattagttatagattccccctcattttccttcatcttgtgaattcctttttctctttcttctaaactatctttaagtttcttcctctcttcttcaagtctttgccttccgccacctgctattccaagcttttcaagctctctcatagcttttaaaatatcatcagcttcatctttagcatttgcaattatctctttagcctcacgtctagcatccatataagctttttccctagtattttctaatttttcaagcttttcctcatacttctttttaagatcttctgcttgatctctaagcatcttagcttcccttgcttcttttttagctattatacttttttcttgaagttctctgattagattttcaaattgaagattttcttcagacatgtattcttttgcgcgtttaatgacaccttctacaagtcctaatctcttagaaatctcaaaggcatttgatttacctggaaccccaattaataatctataagttggcctcaaggtttctatatcaaattcaacagaagcattttctacaccatctgtttttaatgcataagctttaagttcactatagtgagtagttgcaattagctttgcgcctctatttcttaaagtttctaatattgatactgcaagagctgctccttctgctggatctgtacctgcgccaagctcatcaaataaagctaatgacttgtcatctacatgcttcatgatattaactatattagtcatatgagatgagaaagtagataagctttgctcaatactttgttcatcacctatatctgcaaatatttctttaaagaaggctatagatgagttatctctagcaggaattaataatccgcttaatcccataatatgaagtaagccaacagtttttattgtaacagtcttacctccagtattcggccctgttatcattaatgtttgaaattcttctcctagatatatatctgatggcacaactttatcattttctattaatggatgccttccagagaatatactaaatgctccatcttctctaactatcggctttatagcatttaatgcagatgcatatcttccctttgcaaatataaagtcaaactcaacaaggacctttaaattactcaaacatgagtccccattaattttaactttcagagaaagatcagaaagtattctttctatttcagccttttcttttaaaaacaattctcttatttcattgtttaaattgactaagctcataggttcgataaaaaacgttgctccggttgagctttgatcgtgtacaagtcctggaacttgacttttatattctgattttacaggaagcacatatctatcgcctctcatagtatataaatcatcctgtaagtattttgagttacttctaacaatagaacttattttttctctaactgaagagttcttttcttttaagcttcgtctgatattacagagagtttggctagctttatcactaatttcatcctctgatactatggctctttctatttcgtcttctaatgcttttactggagctaatatataagctaagtcttcaagttttggatatgacttttcaacttcttctcttttaaagaattccttcatatttctcgtagctttaagcattccacccacttttaataattgtcctggtgataaagttcctccctttttagctctttctataccttcatgtatatcagctaatccttcaagtggcggattcccctttgatattaagatttcaagagcctcgtttgtctcctctaacttattatttatttcatataaattatcataaggctcaagatcctcaacttttgctttagcagcatttgttcttgcatatttcttaattttttcttttatcttattaaactctaaaattcttagagatctttcattcatatatcccacatcctaacaatcaatcaacaattgacagcatataagagataactaagaattcatacttataaaacttaaaatactctctctaacaagtttcaaagtaatttgcatcttaatcatcaattacaagccgtcaactatttcttggtattattctactccacgtttatagtggcctttagtatatttattattttcattttttgctttacgagcaatctgatttaaaacatcttttacttcatcataactttcatctttaaagtctactctaaaatttgaaatattaaaagacttaagttcttccatttcatcaattaaattggtagttattgaatttaaaatataacttctacagctattatcacccaaaacagtaaaactttcattcattctatctattaacttaaaattgtccttcatacacacgccactacattcttttttagatgacttattaccaaaagtacttcccataggacaatattcactaatcataagctcagtttttccataaatatttattcccatgttgcagttagtgttcttcattaattcttttatttcttttcgatttagttcaagacttaagaatggaatatcaacgtcttgcgcataaaattcagccgcttctttattaaatatatttaatttataatctcctattataaatagcttatctttatagatttttattattccagcattagatgtaattattccctttatataaggttttagttcatctattatttttactatgctattaaactcctgcttaatgatatttggaacttttaaatatatatttttatcttttgaagtttcatataaattctttaagtcatttttattcaacgcatgtttttgcctgctgaaaaatatatctaacgctatattttgagccttattatcctcaagtagtgcctttagttgatcttttgtaatacaactataaatgtagcctaagttttcctgagattttgcattccattctttaataattccttctgttcttttccttctatatgaacttacttcttcttttaaaatcttttcaaataattctcttcttagattatttatagatgaaattcttataaatccgtcatcaaaaatatcaaaaattatcttatcaaatctatatggaatttctcctgattttcttaaggcttcctcaactctttctcttgttaatggtttattcgttgcctcttcaaccatttctccataaactctatactcttttttattgtattttgctttaatacaaagaggtgaattaactttaaattcaatctcaccagttaaatttatcttccttttataaggttttaaatcatcatttaattcatcataaagttttttgtcagacatcttatatagcttatagccttttttatatccaccagttggaaataacttaactgtttcgcccttaaaagcttctttaacttcattattattatttaaaatcttacttaaagtaaatccatcgtcattaaaccttataccatcacccaaagatacgcttgcttctagtttaacttctccactgttagacacctgacctatatatacaccagtatttttagggtaattatagctcatcatatcttttcctacatttttatatagatatgctttagcaaaaccttctcgattaaatagttgtgctaattcttgtcttcccctttgtaaatcaaactttgtatttactaacaccttatcaatagcttttctataattccttgtaactccagcaacatattctggctttttcattcttccttcaacttttaatgacgaagttccactctttataacggcgtccatatcatcaataaaacatgtatctttaggacttaaaagataagcctttctttctccaaaattttcacccttcaaggtatactgcattctacaaggttgtgcacaccttcctctatttccgcttcttccgccaatcatagaactcattaagcactgtcccgaataacatacacacaaagcaccatgtacaaatatttctgtctcaattcccaaatcttttgaaatatacttaatttcatctactgtaagttctctagataaaactattctctgcattcctttttctctaaagtataaggctccctctgcattatgaattgtcatttgtgtagatgcatgaagttcaaaatcaggatacacatctcttattaattttactaaccctaaatcttgtattattattgcatctactccaatttcataaaggtatcctgcatattttaaagcttcctttaattcactttgttttaaaattgtatttatagtgacatatacttttacattatagctatgagcataatcaacagccttcatcattgtttcattatcaaaatttgatgcataagctctagctgaaaatttatttccaccaagatatattgcatctgctccattatttatagcagcaattaaactctccatgcttcctgctggagccagtaattctatcttattcatatttctccttcattgattatcttttcttttttacaataggacctacctgttcttttttagctcttgcaatttctatttctttatttattatttctgcttgtagctcaaataacctattgtgaaaagttcttgcttcttgattaagtttatcattttcattagctaattcttctttttctttagctattattgacatctttccttgtaaatcatctattgataccttacttgtattcaaatctttttccttagcttctatttccctttttaattttaggaaaatcccctctttatcttccaattccttttctaatctagctaaagcgctctctctacttgctaattcttctttaattcttcttaagtcattttctttactctctaatgtattgcttacttcctcaatctcttttaccttaatattaacttctacttctttttcttcatgaacttctttaagttcaccttttagcttttcattatcatttcttgttatttttaattcctcttctaatctttctttttctctatcagaattctctatttcttgtgataatttatcgttagtatcattgatatttttaatttcattattcaaaatatcttgttctttctttaatttattaatttcacttactaaagtatccttttcttcatttaataaatcaatttgatttaccaatgcttcattttctttatttagcttacttaatttttgcttacattctgtaatttctttttctgattcttcaaataaatcattaatctgcttattaagatcagctttttccatattattatcttgaatttgttttgttaatctaacagcattatctttttcaagttttagactattatttaattcctgctctctttcaagtaattttttaattctcttattcaattcttcttcacttagtaataattctgtaattttattttttagtatttctttttcttctctagccttagatgttattgcattattagtcgtaatttgattttctaacttttccttatgccccgcaagttctttagcacatttatgataatcctcatttaatttttctaaatttgctttacatgaagtatattctttgtttatagcctctttattattaatttcatattttaagttttcgcttgctttttttaattgctcacaaacattattataatcagcttctagcgtgatattcttttcttgtaatagaagcatcttattttctaaatttaacttagtttgagtaagttcttttatttgtttatctaactcaaaatttacggcagtcatttcgtttaattgttcagttaccatatctttttcttttctcgctttagtaagttcgctagttaaactacttacttgttcattagcttgttgcacttgcttatctaatctatgctctttgtttttggcctcatctatcttcttataaagaatcttgctcttctctttatagtcggaaatatcttttgttaagacttcattactattcttatttctcttattctcatcagttattaatttattttcttttttcagcttttcattttcaattttcagtttattaatttcatcacttaatgaactaaattttacttctacattattatatttcccatgtagctcttcttctttcttctgaaaattactttgaagttctgatttttccttatttatattttctaattgcaaactaagctcgtctactttcttctttaaagaagaattttcactactaatagcttcttttattttaactgctttatctaattctaaatcacactcgtaaagttcatcagctatatttaccgccgccaaaacagaagcatctgttgtactaaaactagccttcttagacaaaatttctttaattcttgtatcaacaaaatttgctaccccaagcaaatatttttcgtctttttccccttttaagttataattcataccatttatattaactgttaccctaatcataataatagcacctcgtaaaattctttattacttctaattatatggtatattcatcaataaaacaattatgttaggctaactgaaccttgaattcttgcactttttctttaaatttccgaaaaacaacctatatctattcaattgctaaaaaagttttcgtacttcttaaattttatgctatacttattttgattattttattgtttaattgtataaaaatgattaatattactttattgtgttaatcattcttatatataactagaattgggcggtgagtgaaattaatattaaatctattttaagcatattactatcaaaaattactgcgttttctgcaaaacatattgtaaaaggcggaagtaattttcctggtaagatagctttaaaaattgataaatcaatcttaaaacatgttagcaagggatacaaggtaattttagttactggaactaatggaaaaacaacaactacaagcatgatttacaatatcctaaaggaaaataaattacacgttataacaaacagcactggagccaatttatacccaggtatcgtagcttgttttatttccaactattctttttttaagaaaaaagaatatccttatgcggtaatagaagttgatgaggctaatgtaaaattcattacagaatatataacccctgaaataataactgtaactaacttatttagggatcagctagatagatatggagaggtttatacaactcttgttaaaattttagaaggtgtgactaaagttcctgagtcaaaactagttttgaatggtgatgaatctttgctcggaaagttagatgtaaaaaatccagtagtatattatggttttaatacacctattaaagaagatgctacattggaaataaatgctgatgcaaaattctgcaagttctgtaaggcgccttactcatataacctagttacttataatcacttaggcgatttttactgtcctgaatgtggttataagcgttccgaacttgattatgctgtaaataaaatttttgatttaacacctgaaaactcttctgtattaattaatgacactgaagtttttataagccaatcaggtgcttataatatttacaacgccttatgtgcatttgccatttcaaaagaacttggaatagaagactcagtaattaaagcttctcttcaaaatcaaagttcaagctttggcagacaagagcaaatatctattgataataaagatgtacaaattatattagtaaaaaatcctgctggatataaccaagctttagatacccttgctcttaatacgagtgaattttcagcggttttcatgttaaatgataattacgctgacggacgtgatgtctcttggatttgggatgtagacttcgaaaaaatatctagtttaaaaatagaagatatttttgtatcaggaattagaatgtatgatatggcagtaagattaaaggttgctggattaaatgtagataaatttattttaaaagaagattatgaagagcttacagataaaattaaggaatctgcatctaaaaaaatatatatattagcaacttatactgcaatgattaattatagaaaatatcttcattcaaaaggttatataaaaaaactttggtaagataaggagaatactattatggaattaactatttgtcatttatatccggatttactaaatgtatatggtgacgtaggtaatgtactcattttaaaacatagagcagcccttagaggaattgatgtagatataataaatacttcaataggtgaaaacatagataaagacaatgtggacatcatcttcttcggtggtggtcaagactatgaacagtctatagtctctaatgatttaaatgagataaagaaagacgctttaacaagttatattgaagatggcaaagttatgctagctatatgcggcggatatcaattattaggtaaatactacactgctccaaatggagaaaaaatagatggacttggtattttaaatctatataccgaaggcggggatactagatttattggaaatacagaaatatttaacgaagaatttaatgaaacttatgttggatttgaaaatcattctggtagaacatatataaatgaccatactccccttggaaaatgcattcacggatatggcaataatggtgaagatggatatgaaggatgtatctataaaaatacatttggttcgtattttcatggctcttttctttcaaaaaatccagaatttgcagataggcttctaacattagctttgaagaacaaatacggagaagatgtaaaattagaaaacttgaatgataatttcgaattaaaagcaaaaaattctataatacaaagactaaagtaaatattacaaaattgtaaattctcatatattgtttgtaactttttacataacatttattgttatagcattacataaatgttatacttaaaatgttttattatacttaaggcatgttaaaaaagattattattttatatatgtttaaaagaagtggagagatttgacttgaaaaaaaatttaattttaaaagcatttgcattaaccctttctctttctttatttagtccattaagtatggcaagttatgcagcaagcaattctgcaaaacctaatactgaaacttcatcagagaacttaccaaacattaaagctgaagctgctttaactatggatttagaaacaggagagataatttattgcaaggatgctgacagcaagagatatcctgctagtacaacaaaacttttaactggcttattattagctgaaagcaaagacaaagcagatcagcttgaatatactaaatctgcaaaggaacaacctgaatactctttaaatttaaattatatgcataatactatgcagcctggtgacaaagtaacttccgatgatataatgaagggcttactacttttttctggtaatgatactgcatatgtaatagcagacaatatttccggagatgttaaatcatttgctgaattaatgaataaaaaagcaaaagaacttggagctaataatagtaactttgttactcctaatggacttcatgatccaaatcattacactacagcatatgacctttcaataattatgaaggcagcttttgcaaatccttgggaaagagaaacaatggaacttgaaaaagctcctataactttaaagaattctagaataattttagaaaatagaaacctaacacttggtaaaaatggtaaccttgctggtaaaactggtacaactaatgaagctggcggttgtttagcgactgtttatgatagagatgggcgtcagttaattggtattgttcttaaaagtagacaaattgataatgcagatatgacaaaatttaatgatatggatgctattatggattatagctatggtgctaaaaaagaagtttataaagcaaatggtgaaagtgttggaaccgctgatgtaaaatataaaccatttatattatttgggcctacaaaaactatctctgttccaattaaattgactcaagatgtgaactattataaaaatgctataaacgattctgaatctcagattacttataaaggaacagattctactgcatggagtttactattcaataaaaatactaaacttacttatagtacaagaaatcattctgaagaagttacaggttcagttgatatttcactaggttcaataattaaagataatttaattatctacatttctactttagtaggtttggctattatcgtaactcttattgctcttattaaaaatgctgcatctaattcaagacgcaagaataaaaattactatagccgttctaacagaagaagaagataattaaataactttacttaatttctataatatatcttaagcatcttcaaaaataggttgtattcttcctaggtatttgaagatgcttttatttaaggagtaattaacatgaataaattgaattttaaaggcagtgttatgcttaatcccacgcctgtagtacttgtcacatcaaaaaacaaagatgataaagttaatgtttttacagttggctgggtaagtactgtttgtactaaagaacctataatagctatgggaatacgacctgagagattatcttatgattacataaaagaaagtggtgaatgcgttattaatttgccaactagagaaatggttaagatcgttgattattgtggagttcgctctggaaagaaggaagataaaattaaacattttggtttgcaacttaataacggtgaaagtatatccacaccttcattgcaaaaatcgccgatagctttagaatgtaagttaaaatcaattacacctctaggtacacatgatctattcctgtttgaagtaacaaacgtaaaggtcgacgaagacttaattgattcaaatggtaagatatgctttaacaaagctaacttgatttgttatagccatggtgaatattatggcttaaacgctaaaccattgggcacatttggatattcagtaaaaaagaaaaaaaaagtacataaaaaataataatcctcaatttattttatatttatcattaagtttacagcagttacattgtcttttgccatgtaactgctttcttatttatataatatattttcaatgtagaataaatttaatattaaaagacaatataataataaatattatagtttgaaattgtcatatggaggattgaaatgagaatattaaaaaagatagtatcgttcataattatattagctattatacctacttataatcttaaaactgctttatatgcaaatgcacaagttatcccgaagaagccagtaaaggttgcaacacttttatttgctttcgatgatccttatatctctttagtaagaaacagcttggaggaaattcaaaataaaaacaaagattctgttagctttacttttttggatggtagaagaaatcaaggtatacaaaatgctttattagattcagcgctccaaagtgattacgatcttttattgataaatttagtcagcttagataaaaatactgtagaatcagttattaggaaagcaaaacaaagaaatattcctgtgattctatttaatacagtaccttttgatactgagcccatcaaatcttataatagagctcttgttgtatcaacaaatgctgatcaatctggcattttgcaaggaaatttaattgttaaagaatggaactccgataaaaaaactatggatagaaatggtgataacgtattacaatattttatgttaaagggcccaaataatagtactgtaacaaatgcaagaagtacatactctatctcaactattaatgatgctggaattagaacacaagaaattttatctaaattctgttattgggatgaaatatgtgccaaagattctactgaattactatttttgagatatggagataaaatcgaggcaataatttcaaataatgatgccatggctataggggcaattgaagcattacagaaatacggatacaataaagaagataaatcaaaatatatacctgttttcggaattgatggaatcccagcagctaaagacctaattaataaaggtgttatgacaggcactgtttttcaggatcctaatcaaacagctgaagccctttattccataggaatgaacttagttgctaataaaaatcctcttgaaaatacaaattataaatttgatgaaacaggagttacaattcaaatgccctatcaagaatatactcctcaaaaataacaacacattctattaattaataaggctgttttaaagcaattaagatatatatatacctaattaatttaaaacagccttattgtatgtagctaaaaaccgaaatttacaaattaaaataacccagctcacctatgtccgccaagtaaataattaatgtaattttatgaacttacttataatataaaatgtttttctaattcttcaatcattttagatttaaaagcagtaaatttattattatatttacaacttactttttcatgcttcttgtcatatacaactagggaaatataaacagtatcattgtcataagaaagtaaatatcctagttctgaattctcttctaaatctatttttttatactcattggatactatttgatataaattattctcctttttttctaaaataacatattgtgatctgatctcatcattttcatttatgctacaatatctttcatcacttaagtttataaaaatattatcatcattatatttcccaaatggaagatacaaatacctcttctctttaatgaaagaaataacagaatcttttatttcgtcttttctccccttgtattttcttccatccttgttgattgaaaatattaaatccgtatactttccatcccatttaaaatatttcctttgccattcctcaagaaacaataacatattcaagaaatctaattcactgtacttcttttttattaaatagtccttcttaagtaaattctctaactgctcacctacatttttatctatttcttctaaaatagtagcttgtcctcgcttactcaaaaaatctccaaattcatctccaaaactacttgttaaaattatcttaagaatcattttgttatacttcaaggatttttctttaatattcttagcgtatgtattttcactacaactatctaaatattttttaatcaaagttgaatctttttggatatacccttcttttctcagcctcatctggcttagatccttttttacatactcatccataagatgatcctgcttgtccacatctttggcttttattgatgtaattataggtatagtctttgatactttttcttctaaaacttcttccacattagttaagtagcttttaggaaatttcaaatcacatttactatctaacttttctttaaatttgttaactatatttatttcttccataatatttacttcttttttggatacaactttttcctcaacttcagatataataagcaatttacttctttcaaaagcataccctagtccataagttataagaacttcatcatcgtgagccatatttaatcttctcctacaccagcattaattttttaatatcataaactatcattttttaaattattcataattactctatcttaaataattataatttgcttttcttcctataatcaacaagtaaatattactaaacctcttttatagtcccattatttataatatacatgtataaatatattttttgtaaattctaatacttatatttaccttataatctgcctactccacttcatatattgccacttataagaaaataacggattatttctaaataatttctttagaataacccgttatttttactgtttacttttattagtatttttaagcttttattttattatatgatacatgtataatgctaaattatatactaacggagcaattatcactgtcattattcctgcaatgccaattgatagactactcattgccccttctacttccccaagctctaaagccttactagtgccaactgcatgagatgccgttcctatagatacaccaactgcaaccttatcttttatcctaaaaattttacatatagtcggtccaaatacagcaccaactatacctgtgattataattgcaaggactgttattggaacaactcctcctaattgactgcttattgatattcctataggagttgttactgattttggaactaatgattttattacacttgcattaagtccaactaaataagatattcctattatagaaattattcctatagcgctaccaacaaatatacctgttaaaatagctttagcattctttttcaaaagatccagctgtttatataaaggcactgcaagtacaacagttgatggtccaagaaacatatttataaattgaccacctttattatatgtatcaaaatcaatatgaaatgcaaacaaaaaacatattataattcctattgcaattagtagtggatttaaaattggtattctcgtatttctgttaatgaatataccaacttcaaaagccgcgagtgaaagtactagtccaaataaaacattgtttattaatatttgcatatattttcctcttttcttatgactttatctgtacgtaagctaaatattttttcttggctttcttgaaatagtctgaacgacaataccagtcaccccaattattattatagtcgtcaatatacatactaataataattgccaccatgtggattttattatcccaagcgacgtcattagtcctactcctgctggaataaagaaaaatgccagatgatccagtagaaaatttgttatattggaaatactatccactttaatcacctttgtgtataataatataaataatattatcattcctaatatatttcctggtatcggtagatgaagcatcgatgatataagttctcctgacagatagattccaaatataattagtgcttctctaaatagcttcaattttatcacactccaattatttaagcatatttgttaaaaaaccaacttctctctattcttaatatgccctttataatttaatttaccatcattgcattgataagtaaaattcctttacactttaagtaaaggttacctttttgttaaatatccttatattttcagtattatatattaattgcactttaaatataagtttctaaaaatatgtttaattttattcattataaaaattaaaacgacttatttcttatataaataagtcgttttaagagagtatttgtggagtttaatagtatacttttaacttctatcctttacgagtttattttctactattgcaaccacctcatacatgataaatgcaattgctgataatattacaatgctcatcattaccatatctagctgagccacttgtcctccatatactatcaaaaatccaagaccattcttcgctactaaaaattctcccattattaccccaacccaagataacccaacatttatctttagcgctgatatgaggataggaatagagtatggaaatattaaatatcttaatatctgtatttttgtcgctctaaaagtattcataagcataattttctctttatctatttcattaaatccagttaatacacctataattgttgttattactgatattaaaagagcaatcactattattgctggaataccatttccaatccaaaatattattattggagccaaagcaactttaggaagtgcatttaaaactaccaaatatggatctagtatttttgatacaaaagggctccaccataagattactgcaattagtgcgcctagtattgttcctaaagaaaatcctaagatagtttcatagcatgtgactgcgatatgcttaattaaacctccaccttcatataaagatacaaatgattcaattactctagttggactagaagtaagaaacggatcgatccacttaagatttgcagctatttgccataaggctatgaaaataaccaatataagaattctagtaattaaaatttttctttttgttttctttaccttattcaaatatatttcatgttccttagacatattatttgcttcactaacatttacacttttcttagccatttccatcattcaactccttccataacatattaaaatagtcactaaactctggagctcttctcttttggaaaggagtcaattcttcatcgctaaaatgtataggaatttctgccttcacactagatggtctcttagataatactattactttttcagacaaagaaatcgcttctgctatatcatgtgtcaccattattgctgtctttttttctgtttttattatcttataaacatcatcacatactaaaagcctcgattgataatctagtgctgaaaatggttcatctaaaaagagtatctctggatttaatgctaaagtccttataagtgcaactctttgcctcataccacctgaaagttcactaggatgatggttcttaaatctcgttaacccataagcatctaataatccacttactctttcttttgattcactatttagctgcttttttatctttaatcctaagattacattttcccaaaccgtattccattcaaataaatgatccttttgaaacatatatcctatcttatccaaattcttttttacatcttcacctttgtataatacgctcccattagatggttctaacagtccactcattatatttaataatgtagattttccgcatcctgacggtcctaaaatagaaataaatttaccatcatctacttgaaaattaacattatttaaagcctgtgtttcacctttaatagaatgataattcattgatatatttgatatttctaacaagctcaaataaaatcaccaccttttcatctttatgtgacctttatttagctgctttttcagcaaaagaattatctacaattttgctaaattcaggtctttgcggcattaagcttgaatcataatcagtaattatatccataagtctatttaaattttcttctttaatttcaggtgtatgagctatagcatcaatctttttatagttatctataactgtcataattgtatctttatctgtacctggaaaataatcaattatgctatctgcaacttcctctgtactatgactaaaaaaccactgctgacctttatagatagcatttgtgaacccttgtattacttgtggatttttatccatataagattttgttgtaaaataacaagtataaggaattaatcctgattcttcaccaacagatgcaagaatatatccagttccttctttctgaattgcagaagctgtaggttcaaagagagccacataatcacctgtaccgcctttaaatgctcggtacatgaaaaagcgattttagaaaactgtattttgagaattgatttaaaagatgagtttaaagatctgccagcaaatacgattgctgaaaatttgattagattaagaaagttaaataatttaacacaaaaagaattgtcactaactataggtattagcaaatcgagtatatcaaaatatgagcgtggagagctattccccacaaaagagcaatcgataaaactagctagttattttaatattaatagtaaatatttttacgatccgtatttagaatctatggataactttcatcaatatttatccaccgtacttaataaaaatatccacattaataaggataagttgtgtaaatctttggatatatctaaaagaactttatatagatattgttatcaaaacaatgtgccatctagaaatatatttgatagaatggaaagctatttaaatacttaaatttaagatttattctcttaaaatcgtgttaatgaattattttattagaatatatttttataattttatgtatattttatcttaatagtgttaagaattaagatacgatttcctattttttaataaataaagagatagctttggacattactctcctaatatttttttgctatctcttttttttgcaaaaaaataagggtaataaagatttctctttactaccctacaagacttaatgcttaaaaaagaatcttgtaattatcttgggagtctaacgctatccactatcgctgttagctttgtgtgtaacattataatatcataattccacaaattatacaagactattttcatctgatttataagaattattatattaaagcaaaaaaggtagactaagtattctacctagtctacctttactaaacagagtatatgcaatttagtaataatcattataccatattactttatatcataaaaccagcttcccaaagtttcttttagctctaggcatttgctcatagatagattttgagtttcaatccatacccctttttcgtttcccctaaaataacatctaactcctttaaaatattggagcacataatcagcatcaacaccattaaaactattatctccttgatagccattaggtaaatagtttgtaacaacatatccagtagttttatttaatattccatcattaaactcattcatatcacattctgtatttattccgcttacagatcctgtttcactatattggtgtcctactctattagtgaagaaattagaatttaatctccatggatcattattatagtttgcttcccataatggataatctgcaattctattatctaagttatccataaaactagtataagtataaatacctatttgcatattagatagctctttaaatttagcaataaatcttaaaatataatccattagtccatcaaaattagtttccacatctagcattggaatgagatcactggttttatcttttatggcattataaaaattattagcctgactttctggctcactagttccaactaagaaatgatagaaccctgtttttaatcctgcgtaatgtgcatttgaataattagtatctaaataactatctttaaatgttgtcccctctgtagctttaatgtaaacaacttctactcctgctgtttttacctggttaaaatttatatttccgttatgattgcttatatctatgcctttaaacatttagtatcatcctttctcattttaaatataaaaataagagtaaccctaaaggccactccaaaaactctgcttatactgtttgctgcacatctacgtttactgttgctgctgcaagcgattgaaatttgcttaattgatcttttagacttgcgttttctgcttgtaatttagtatttgattcttgcaattccttcataattacggaattatctaatactgcttccttacccacattaacgcttcccgcaactgcttgcctaaaatatataacatcttccttagttagttctggaaatttagcaagcaataatttatcgaattcttcagttttacttttaaatgtatcttcaattttttctgtaatcctaaagttctcatctacaatgctccatacctctctagctgctgtcatgtatgttttattttttaatatacttattactagtcctaaaatttgttttatcattttacatacctccaattatttattaaatattcctgtttgaactgcataaaaaaagaagctaattaaagctcctcccattgcagttataaaccacttcatcatgctagttaagtttttaagattttcacataagttcttaagttctgtctttaattctctcccatcctgttcaagtttatcaatcctatcaccgtgattattaagccttctttcgtgagtttcaattttgtctttcactaattcttcattcatattacacctaccttatttgaaatctttataaaagtgagcaataaaaaaacaccatattggtgcaattaatcacttatacttttatttctttataattactattatactacttataattattaaatttttatacactttctatactttttattaaatttaatgatacattctattttcctatgatgcagtactttctgtagttatatcttctatagctcccatatctacaagaactaattttacttgctcttgtaaatttaaaagtttaggaacatccttatattcataagtaccgcctactatcaatgttacccatacttttacacatccactatttttattaaattgcattctaaacactctccttaaaatcaaatttattatactaagcattgctttttcccattgctactatacttgttaactctgcatttgcttgcgctaagtcatttactttttcctttaaaagctctaattctgttttaggtatgtcttcaaatattgcttcttttgtttcaatatttactgactttgttatttttccatctggaacttcacaagataaatttgttaatatgttatcttctaattcggttccacctgattgtgtaaataatatttctcctgtgtttttattgtatattgctaatgttttcattgcttttcaccttccctttacttaatgctaactaaatttccatgcatgccaactacctgataatttaaaactactggccgaatcattgtaccagtatattacctgattgcttatataaaaccaaaaattgtctgggcttgaactaaatcctgggaaaattacataagccccttttggtgaagcttgtaaccaaagtattaaatctggtacgaaatttaaagatatattatagctataagaagtgtgatttgaactagttcctgaatatctcggtattgtgtaatccaatgcaccagatacatgttgataagttgatgctgttccaacaatactcttaccattccaaccaatatttacaccattaactatattccacggcattaaattcggaatatgtagtctgtttgtaccggtacctgaatagtacccctttggaatataaagatcaaatgcacctacatattcattagtggcaacaccaccacaaattccagaactgttgtaaaagtcacccgaatctgctcctcccatattaattgcacttgtcatattttcaagagttccaaactttttaactccatcatcatatccactatatccttttagcaaatattgaggatctaataatgcatctgctgtatctacaacggaagatttacctgtaacgccatctatagtaataccagctcttatatttcccggaactaacaaagataaatcaagacctccagttataccagtatcattatcattactaaaggtcgtattcctacgcacatctttcgctagtgcagttccttccgcactagctttgataaaaaaacagtcaccagttgagttataccaaactgtatacgcctttcctgctattaaatttggtgatgttgttgttcctggtttatataatttttttccatttatagtgattgcagctcccccattgtttgcacttgctataaaagttattggatatccatttactaacgttcctttaattgtaagtgttatggctgtggctgatccgcctgctgtttgatacaccatatctaacaattgcgtatctattgcatttaaagcgctttgtaatccatctacattagctataatgtgattatgactatcatctgctacggtagttgttatcgatatatttcttgagccatcgaagtcggctgaaccagtaacatctccagctaatgctatattcctaggtgtctgtatcttagttgctgttcctgcattcccacttatacttgttttattcgctaccgctgcagttacaaaagcagtattagcaattttagtactattatctcctgcagtttgagttggcgctgttggtgctcctgttaaccccggagaatctagcggagctttaagaggtaatgctgagttaatttcttttagctttgtatctataatatcagcattaccattaaaatcatctatatttacaacatcagttccttctggctttttcaatccataatttgttgttgttaacatttaatcagccctttctattcataaacttttaactcatcccatgtcttcaattttgcattgttacacgtcaatttattttcttttaatacattccaaacggtataagtatatttaatcgtgtatcctagatgtgcaggtttaatattttccagcatatctttaaataactgcatgttttttggtatccccttaactccaacaaattggactacaaaagcataattaggattatcttgtattatgtttacttctccaccagaaaaagtttcagctacatttttaatcatctgtttagttgttgtaccttgccctctttttttagctttaagtacttctcgtctttgttcataccctaaagataaattagtttcaattccatattcattttcccaataggtaagcccccatgttgcagtatctatccaaagttgattctttatatccttaattttataatttaatcttccaagctccagcgaattagaatgttctaattccttcataactttagatgtaatataataatcaggcatatatcgcataagatcaggagatattagttttatttcatctatgttatcttcttcattaattccatatttggttgtaccataattcatgctatacccctctaaatcattccatgacaatcctttttttagatagactgaatcatgattatgtgtacttggacttgctccaatatcaaatggagttggcttcactgagttagagtatagttctatccatgttgaccacgaacttccacttttagttcgtatataaacatgacctacatttactgtcattccaaaacctaattgtgttaaatagctttgatcaccgctacatataaccataaaattaaaccacccactcgaataaggtccatttacaggattttgtacatcataccatccattagctactatattattcaaatcagtacttgtatttagtctttgaccttttcctcctaatccatatccactaggtgcaaaatcactagcatgttttccatctaatttatctgcattatctataatcccatcgctattagtatcatatatgcttttaagcatatcaccatatccagcattagatatttcgtctttagttgcaaattttgaatttgcttctgattctgtataatatctatcatcatgagtatgaggttttggagcttgactatttacaccagaactatcaagagtggccactccactagcagctcccatttcacttctttttacttgagggtcgttagttacattccccaatccaacatcagttttagttgtgccatgtggattagttccacttggatgtgtgtaaactgttttttcagcaccatctatctttatgttcccattagttgtacttacttcaactttgttagcattactgctaatcccatcaattttacctttatagttattatcaaagtcatttgtagataaactttttcccgttattttatctaccttattacttacggtattccataaggatctctcatcacttgtaatatgtttaacactatcactaatatgagtgtaagcagcattccaatatccaattaatgtggctgttatcccatctattacagatttatttccatgttcatgcttcttattatttgtatctgctaaatttgctttttctgtatctgtataatcattggtgctaagtccctttcctgaaactttatcaactttgccagctaacattgtagtcatagtcgtagcaaaattaggatcatttccaagtgcatctgcaatttctttaaatgtatctaaaacattaggcgcgttatttattaattctgatatcttttgtaatacttcatcctttgtataaactttatcctttgtatatctattagataattctgcatctatagaactttctttagttttagctctatttatctcaaaatctagatttgttgttaaaatagactctgcgctttttgctctagtaatctcagaattcaggttaattgttaacgtattttctgaactctttgctcttgatatttctgtatttaaattatcagttagaactttttcagccccagtagctctattaatttcactattaagattttcttgagtctcaacgactgcatcctgaagtttattaacatcttctgcctcaacttgatctcctaatgtttcatagcttatataaatagggcttacattagagtaaattttaattattgttttccatggagttaatgatggagttgatgtaaaatatgcttcaatcttatttcctgtaagtttacttcctgtataaacattcaatgtctttagatttacattatcatgttgtagctctgattcataaacgccatttaatactttgacaacttcctcaattacatatatattattttcaagtttattgagcttctcatggaattgagttacattcaaatcacatcacccccaaatttacatttcccattactgcaatttcttcatcagctaaattaatatttgatattgcaccattaatttttaaatcagaataatccataacgccttcagtgcttaataatatttttcctatctttgctatacttatatatgaagcattgaatgaaatactttgtaaatgctctagtaccaatgtcttaaaagttgtttgtattattccaagattaaatccattagttatactcacatttgcagttatatttattgctttttcaatcgctgaaacaactgttacagttgccccaattggtgcttgtccttcacccattccatcaactggatcgatatactttttaacactatccactaatgttttatcagctccagtcttattagcatttataataacaacttttacagttccgtttcctgcccaaagtggtacaactcttgcatctccaacgcctgttacctctaatgcccaatttctataatgatatttattcccagacgttgcaggagtctgaattttggcataatatctttttcttaactcttcatctgtctcttcattatatccattagaaatagcttctttattaattactttttgtagtcctgaaagtgtctttggaaaatatttaatagttccaactggtatattacctacttcaccgtacttcacacattttactgaaacatctataatcccactttcaggtataaccaatgtttctgtaaattcaaaactaacactatcactagctacgagttcacctttatttataggagagccgactactccagtaattgtaactttcccgatagattgagttgttaatttacgtgttaatccaacatcttttactactttatcaagatcctttccagctgctgtttctgcaaatctcttatctaatacgccttcaatttctgtatatgcattttctaattcaatagcaactggtttctcagcatcatacatgaactcgccttcgcttttgttatattcatcacttatattgctaagtaatctagcttgtataacagctctgctatcgctcatttctacgtcaccacactttccgtgatcgtaccataaacacttataacatcaaaattacaattaagtaacgttttatcttttttaaatacaaaattatttacagattttatatcagaatttcttagtaatgcttctgtaattattgtttgaatctgtgcttgcttataaggcaaaggatattcactcattattaaatctaataatgaatcaacaccatatttttcagaatcatttgtattatatattttgtatttattcttatcagttcttatagttttttgtatccattgctttaaagcttcatatttgcttactatttcgacttttccatctttaacattaaaatctcctagctcaaaattgaaaccaggagatttaccaccactattcattatatttgcattgtttaattgagttattgtactaaccgcctcttgatttggaaacaaataatatcacctgcctttaaactctatccactgccacataagcttgaccattagaaataggaatacataaaactttatcatttacacctaaatctctattaatagaaaaacttttttgcacctgatcctctatagtgatttttcctgctataccttttaagctttcacatatatatagctgcgcattaatatcatcttctgtaaatatggcagcaccgccaaataaagaaactttaataggatctaacgcaattatctttccaatcctcacctcatcagcatctctattgtctctttcccttaacaatttcattaagcctgtatcatatctatccattttatcacctaccaaacaactgtaatactaactttgtgaatcccattttctaatttatgatttgcagtttttattttatagtacccatttaatctcttaccagcagttaaataaatcattctatttggttttactaagtcaccattttcaacagcaaacatatcatttaaagaacatgaatactctattttattactattagctaatgtattatttgcaatattttgagcttgtgcaacgttcttatcatctacagttaaattatcgcttaaaataccataaaagccttgtttacttgcatcttctgctgttgcttccacttttgctttaccatcatttccgctagtaacagttattttatttttcatattttccatagacatttctatatctatatctttaggtaaaattaatctaggagttattttcatttctgaaagttttctaacatataaaacattaccttcaatttctttaaaatatgttgttccttgatcactttgtgcttgatctaaaatatcatcaattatttgtgccatagtagtattgacatatgttttacttatttgagttggaatatctgctataacacaagttaaataagcttcgccagctaatgattttattgcttcatctgctcttatattataaaactgcttaactgatatcttattattttttaaataaaaactatagtcctggcatgtatagctccatgtccatctcctttgaattggcttgaatgcaattcctctaaatatttctaatgaatcattaaacagttgtatgactgtccctgttggaatttcttttatactatcaaaagttaattgactacctatattatcagtgtctccaccccacgaaatagtattgctatcttttattatgtcttgattattaacaacaagtctatacataacaccacctaactttcaatccaagcaccatcatcaccaaatgtatattgaacatcatctattgtagccgttccactaaaatacatcgcgccatctgaaccaaagtaataccatttatcattgtatttaatccactcattcctagccatcatacaattatcttttagataataccaatatcctccgtcctgcaaccaactagattgcctagcataacctgcagcattgaagctataccactcattatctattaactgccaagagtctttataataatttcctgatgtatccgtgtagtagtaccatccagttgaatcttgttgccaaccaacctcataaactttaacaatagtagtattgtaatctctccattgtttaagccctaaagtatattcataatctccatttttcattatttgaggttcaaatttttcaatactaaaagtatcattcacatggtaaccatctggagtatttataactaagcgaataggctcagtatttgttttagcattttcaattaagtcgattatttcctttgcattaactttacttttagaaaaataatacttgcttgcatctcttgggagccaatcgctccatgatccttgaagcaatccctttttctctatgaagttatatggaatatcccaatacgtttcaaactcttcatttttactctcactcgaaaacgcaggcagcttgcttggtattgttgggaattgcaacacttttgttctgttgtaatcacttatatagatattataattactcatagcctactttcctttctaagaattaaccatttgatagtataatttattaaaaatatgttgtcctacttggtctgcaaactcttcattacctatcatatttccttgaactgtcaattgcacaattattgaagcaccactattattcaatatcttatctgtttgacctgctggaataacttttgatccacttggaagtattgccatttcaccattaccaaactcattcattctagtagggccaccagaccaataatgtgttcctgttgcattcataggtgttcttgaatatactgtatttccacttttattagttacagatgtaactgtttcatttgttgttatatcaactgtagatccatctaaaccaaggaattttttaagcttcccccatgcattttctgcccaatcacatatttcttgaaaatgcttaacaacttcatagatagcaaatcctaagccagctattgcaagcgttacaactccaattggatttgcatccatagcgacatttaacagccactgtgctccttcccacgctgtagtagcattttgtattccccaaatcataagttctattgttccccatgcactagtcgcgaatgttgtaatcccaatccaagtattaactccaacaatagctaactgccatgcagcaattgctccaattatgctatatacaataggttcaattgttggccaattatcatttacgaaattaactactcctgtggctccgtcaattatatctttaattgcatcacttacagaatcccaactatcaggtgttacagctgaaaatgatggtacaacactattataaatggttcttgccaaattagatgcagagcctattaaatcaccaagtgaaggcatgattttatctataattgaacctccaacacttaaaaaagtatcagttactccacttacatcttcttttatttcaggaatattatttctaaaccaatttgcaaaatcatttaaacgaggtaatgcagcatccgaaattggaattaatacgcttgtttgaatattacgtttaattccctcaaatgcactacctacatcgttatattttattttatttatttgtgctaatgcatcatatgtgttgcttatctctccatcaacatttcctaaactttcaattacgtttatacctaaatcttcaaattgagtaccaaataattcaacacctatttggctttgttttaaaggatctttcatatttgataaagctgtaataacatcctcaaaagtatcttttgcgctatcaccaccttgagcaaatttagctgctaaatcatcagcattaaatccaagctgagagaatccatctgctgttgttttgcttccatctattgctctaatagagaattctttaattgcatcaccgactttatctaaattaaatgcaccttctgctgatccggccgaaagaatattaaacatatcttcagcatttaatccaagttttttgaattgcacactgtattcattgatagaatctaacatttctccactaaaatctaatcccccttgttttccttgtgcaattaaattaaatgcttcatcaccatctattccaaattgtttcattaaagttgatgctgatctaacagattcttttacctcatatccaaaagtgtcttttaatgctattgcattttcagttagtccttttaaatcatcaccagtatatcctgtctgctctcctactgcttttaacgcttcacctatctcttcgaaattctctccaaaattatcattgtatatatctagcatgacattcttcattctatccatgccagtttcagcaagtccgctagatgtcataactccatttagagatttttgaagttcatttccgaaagtaacagtttcaactataccttctttcataaactcccatatatccataccagcaccaaatccaattcccctgagcatagattctttaacagtattaaaagcttcactaacagtttttttcattttaacagcctggtcttctgtatccttcataccagacttaaatccctgagtatttttagcaacattttgaatagtatcactaaaattatctttcaaatttaatatggtattaattacttttgatgacaaattatcacccccatattaatttttctgtggtttagtattcattaattcatttttataaataacgtattccattaaaagctctttttgagacttaggtaaactccataaatattcgagggaatgaccacattcaaagaaataacctagccaaaataatggtcctatttctcctttgccattccctcttattagttttttaatttttctttagtctttttgccatcaccaaaagcttcctttatctttttagctataccagctaaattttcaactccaaaagccttaactggtgcatctaaaggatcttttattccccatgctttatgcagttctggattttgtaaaaatgggcaagaaaaataaataaattctttagacgcattagccaataatttataatctgtacctattatctcttcatttttattcattttaattgcatttgcctgtgcatctaaatactctaaaatattatcttctgtaggtcttataaaggttataggtccatatccttctatctctatatcagcttctttccttattccttcacttttctctaatccctttttaataaagtcctctaatgacattttgttcataatattcctccaaaattttattttaaaattgaaaagatgcttaattaaaagcatcttaatattaaatagtttcaataggatcgaagtctccaaagttaaacggaaactcctcttcaattatttttttagattcaaatccagcaagtaagaattcagttattactaccccctctatacttgccttttcactttttcctgttgctttatcagttaagcttgatattaattttatatctggcatgactccacttttatatgcatcagcacaaatcttccatattgtactatcaattttttttactgtaagcgtaccttctcctgaccacccattatatctactatatgttgcattatctccgcaaaactcaaccgtttcaaaattaccttttactttagcttcaatcttgcttaaattagctaaaagttgtccattgaaccaaagattaccgctgctacctgtcaaaactttatttgctaacgcttgatttcccataatttattcagcctccttattacgctaaatttatttcaaagtctaaatcaaccatgctttgtagtatttttacatttgctttactaaataagcttctcttaaatgtattttttttgacttgaagatctgtccaatctttagcttcagctgttcctgcttctatccacgctgctctttgtgcttcaacatttatatcgcttttgttttcgtattccatatcaagtacatcaatactagccaagttcttgaaatacccattaacagcacttataaataaaatttgattatcatatttattcttatatccaccgcctagataatcttctttaaatgtagttgaaatatcatcttgcataagatccattgcttcaaccacctctatctctttcatatcttctgtagctgatttcccatttgtagtagttaaactgttaattccacgtgcaattctaacatctgcaccatcattaattagaataaacttaccagcgcctagagcctcatttctatcctcagcctctgaaaccttactaagatttgtgcatttaaagttattgcatccttgtgtaatattacatttcgctaaaatcccaataagacttggacaatatttttctcctgtttgttcgcgcctgctatcactaaaagttatctttgtattaacaaaattaactacatgtttttcatctggtgaagttacattgtatactaccgctttataagtttttttattagctacttgagattttatccaacttgataaagttgtaaaatcttctgtttcaccatctgccattgttatccatcctgtttttacattctcgataacaatctttaatgcatcagaaatagttgcggatccaccaatctttactacacaagccttatatggagcaaatgtaaatatatcttttaaatattgtaaattatcttccgtatataattctttatcagtgtttatctcagttatatcggaatattctttataattaaacattgcgcttgtatcatctttaactattaatattgcataacctctttcacttctctcaggaagcgaagctgccttttgactgaatgacacatcaatatttggcattgtaactgtcatatcatcactcctattcttctaaatttaaattgaagtttaattcttctattggttctaagttagaatcatcatatatttcctcaagagaatataaatcaaaagtaacttgtaatactccatcagttgtgctgcattctatatcttcagcaatcggcatataaaatgtatctgtgacttttacatcctctaggaatacattctctaataaatcctgcattgccaaattatctagtttaggtttattcttatcttttgcaaaaaaataaaccctcaccggaagggttctttcttttaattgactattaaattttcctgattgtgtagtatcaaatgtaacttttatagacggtcttataacatttatatatgatccatctgtctctttttttaatgcttctgtggtatcttctgatacaatttcaacatcaacaaactcagtatctactaatgcagattttactgtattatttatagccttatttatttgtttcaatgtaaccatattacagcccctttataaatacttcatgtaaccattcttcaacatctgaatagaaaccactttcaaatgctttagcagcctcttccatgaaatgaaatccagggataaatttttcttcgccagtttgcttattcgattgtcctttagcaacatttttatgtggttcccacataaagccatcattaagtaaatgagcatgtggactattattaaaagctcttgcagaccacacacctctatatttataagccttacctgccttgaatcctttaagtaaatttcctgtttcttgacctattcctttacttttaaaaaccgctttattttttttgttaagattattagcttctttttttatgaattttctactctcttttggcatagtattattaactttttcagttaattttttctcaaatttagttaattcactgaaatcaaatccatcattacccatatatctatcctcctatgatttcttcacagaatatttcaagaaactgatgagcaaaataaggatctaatatatatttaatatcaaatctacgcccttgatgtattagccacatgtcttgggtaatatccttacccgcactatatctaaccttaattttatgtgttacattggataacattgtattagcttgttgcttttgcaatgaacctgtttgtggtattattgatgcccatataggcttatccttaactttacctggtctaaaatctttttcctcaagttcattttcaaattctacgtttccccaaacttctattcttttatttaaagcttctatactcatagcgtttcctctgttgtatgttcattagatagggataagtgagcccttatcatttcataagaatctctatacctttcggcttctttatcatctgtgctaaattcacatttacagaaagttttaatagctctaattattaaaggatcagtttcaactatcttgctttctaatattccacttaactttaaatctgccttagctgcatcaatggaatcttgtatttcttcatctagatcgtcatcatctattcttaaagctaacttaattttatctaatatcatacactctcccccttataattgatttctatcttataattctgaaatttaaatacaaaaaaccagcatattatatactggttcttttaatattcttatcccttaagctcccttcttaattaaaagaactccatttgcatctcttaactttccatcaccaattaaagtagccttatctatccattcatctgtattttcatcaaagtatcttttcattgtcatttgtaaattagagttaaatatatactcatttaaatctacgaataaagcgaaaacagcatctgcttcagcattttcatagtttggcaaataatcagcttcaacacataacacatcatatcctccaaatcttcttactggtgatcctgttattccgtagttagttcttgctataggttgtccattattatcaaccattccatcaatatatccttcaaaagttgcttttgtcataatccaaattccattaccttcatatgcaagtgggattttagcaaagatgttctttttccatttatcccacttaccaatatcagttgatgaaattgttatttgttgagcttcaggtatttctgttgtatgttccaatattcctttaggctctccaactccatcccccttaataactgagatctctattgctacaactattgcttctgccatatctgacgctatagttgcttcaaatactggtaatgatactgtatcagcttctaaacttgtggctactctgcattgtagcttatagtaactaaactcaatgtatgtttttatttctttcttttgcttctctgataaagtgccctctgatttccaagttgcttttggcttaacactagcagtaggaattttaactccacctttaaatgcagtttttctaattctactataaatttgtccataagattttaacttctgaacaacctcattcattatagtagtcggaataacagctcctatatcagtagtcatagttgttgaatctgctcttaattcctccgatataactcctgttctagcataattcataaatgcttttctatattcaagagtggaatatttatcttctctttcttcaaccacttcctttttaactcctggaataaaagtttctctcttctctccagctttacctgcatttatttctcctgcctccttaattaatctttccctcgtttcaatttgattttgcatttcatttaattctcttaattccttttctattgctactaaatctgctttaggatcttctaacattgttcttaattctgcttttcttgatgctatttcttttaatgttttcatttataaacacttccttcttttataataaagtttcaataactaacttttttcttagattttctttttgatttaagctttccttaaatgtttctaagctcctacagcacatatcactgctgtcatatgcagggaatgtacatggacttacttcaaataaatctgcttccacaatacttctcttatatatttctttgccttcatattgaacctttgaccatacatcatcattacatctaaatccaaaggatgaaccatcaacatctccacgctgtacactttcatatgcatcatttccataagtattattaggcaaatcaatatcataatttaatccactcatatctgaattaaaccttagtgtccctactgagacacttccgagtggctttgaagtatcatgattccataatgctttttgatttctattttgaagtgatttatcaaaagctcctgaagctatttcctcaagaaattcatctccccatctatctctcattaatgttggtgaattatactttactgcataacctccaatagtctttttttgcccttctgaaactgatctaatttctatcttttccgtcgtcagttgccttacttccttctccttcatctacatcttcacctcctcccaagtcatcaccaactgttgttgtatctaaccttcttaaaggtttatctccaccttcaattggtccaagattcataacatctctccattcattaggagtcattgcactcctgtccaccatttgaactaaattaagcttcgttgccatggatgcatattggagactgttagcttcaaagattatataattgccaaatcctctttcttttttactaaatatacgccttgtaaactctccacttagctgctttgataaaggttctatttcagcttcataataagcattccattcatcttctgtatatttgctttgaattatattttcattggtattaaaaaagctatatatcctcaatactgctctatccatttgagctgcattaggtacatagctttcattctttatttgctctaaatcatatcttggatctgttgctgctacaccttttcctttattaatgcttaagaatgtgtcaacaaatttacttacttctatatctctatcttctggccttaaagtagatttaaatttcataatccacttaataaccatagaattttttatagcctttaccattccttgatcagtagtatttactacttccataagattctttaatgtctcttgtggtgtatcgccaaaaaagtcactttcattaaaatctcttcttaaatgaattatatctgaataagggactgtcattctcttacctgtcataaatgtatatcttaagaacagatctccttctttcccttctattaattccacagacgttgctggaattggatacaattcagttgcatatccaagttcatcacgcttaatataaataaaagcattgtggttaagcatcaactgagttgttaccttttctaacatcatttgcatggtcatatatggattaggttcttcaagaataaatctaatatatggctgcggattaattttaaagttgccattaaaatctaatatatgtttaggattcagttttcctatggcctgtgcctttggtcttattgctgctctaaccaaatcacttttatataaatttccatcccaggcataaaacccatttcctgaatcagtaatcatttcaaatctagtagtaggctgtggagatcttttattcccaaagatattttgaaatagacccaaatattttcacctctcttttaaaccatattttcatattcactcattttatccaaaagtactacatatccaataataagcgaaacacctccatcaatacgctttctattatcagtaccttttattggctgaatattgttatttatatcagttttaatttccatattagataaacaccatttatctattggattattattataaataattctatctgcaattaaatctgcttttaattccttcattggaaagcttaatgtgtaagccccctgtctaactggaatcattgcatcttttccaaattcatcttcatatgcttgaagcaaactatcatccacatgccaaggatcataaccaatccaaggtatataaatatcataaagatctcttaattccttaaaccattcaagcatgtcatatttatttactttattacctggacaaactcttattaacccttgctgctcccatagcttatatggaacattatcatcctctttattagtttcttcttgatttaatttttcttctggtacaaagtacatttgaataacataaatcttaggatcatctcgtctcatacataaaactttagctgatgctaaatctgttgtttctgctaagtcaaagcatccaattccatatctgaatcccatttccttaagattaaaaatagcttcattgttaagctcatcccaacgtaaccatgctgatgctgagttttccttcatgttaaaatctttaaccattacagtagctttaaaggctggatctgatttagctttatttacacaatcccttaaaaattcaacctttttaattggacctaatcctggattagctttaatccacatttcttctttgtcccattcttccttatcatcaagctcataaataaatgctataaatctatcatcctttatctttccatcaagcacaccacatgcataatcatattgtgagtcaaatattgaacctctaataaaaccattagtagttatgcaatctaaaagtggctgccttctactactcattgattgcttcattagatcatatatgtctctgttctttatggctgctaattcatcaatagtaaccatatgcgcatttaagccatcaagaccattagaattacttgctaaggcttgaaggcttccataattaaaaggacaatatatatctgattttcttttcttaagatgtttatttaaatctggtgactgctgaatcattttatagcattcattaaatccctttttggattgatccaatttagtggctataatataacattccggagatccttctccatcaccaaccagcatgtaagtttcatccgctgcaagctctgtagtttttccgttcttccgacctctaatatcaagtacctcttgatattgtctaaatctagtatctttatgaacgaatccaaaaactgcttgatgttttgctttctgaaataattctaacttcaaagctccaccaagctctccttgagcttgcttgcaaaatgtttcaataaattctattggtctatttcctaactcttcatcaaatacccatggataatatttttctggattatgtaatttatcaatcagcatttcatacacttgcttaattcttttacatgcaacaatttcacctgatgcaattttgttatagtattcctctatgtaattcattattttaatttaccttttttaataaattccataagtgcatctgcttcttgctttttaacttcaactggcagcaagtcaattaattgtttcattactcctgaatatcgttgcatgaaagtcgtataaattttaacctctggtctttccctgttaaaagattgttctccctgttcaaataattcagtcaatccttttttaataagatctgttctcgtatcttcaagtgatactttcataaatgcagcttcattaattaacccttcaagaactttagttttatcttttgggaaatccttaaatatctttttaattttatttatctcctgctttatctttttatctctttctaattgttcggaaatgctcaaaaatataccccctcctattttcaaaatttcgttcggaggaaaattgttgtaccctatacggtctcccaaagccactccctgcaagttttcatggggggctatagatcagtcttcatattctctaacttaaccatttgaaacatcaactttcctaaaagactttcttgtttttctttatcaacagtttctcctttgttctctttctctcctagctctatcatttgatctaatgtagtcactatagatttaaatgtatctcttaattgaattagttcatccattataaatcagttctcctttctcattgaacttgtaacctttcttagtaacacttttcttttctctattgaagtcatgctctgcattatgacaatccaaacatagatactctaagttatcatgattaagtgttatgttaggatcattgatgttgttaggcgttaagccttttttatgatgcacaatgtatcctggactctcacacctctcacataaaccatttactgattttatatatgatgctttgcatttcttccacgctacactgttataaaaagctctagcgaactctctagccatttcactcctccacctcgtttaattgattgtataataaaaagcacctacatttgtaagtgccttgtttgaaataaaaaattattcttctctaatttgatggctgaataaataaatttttaactaaattacttgctcatagaatctgttaattctttagtcatttctgtataaactatccaataacatgtgatatcaataagttttaacaaatcgtttatatcatttccttcccatttcctaacataatgtgtttcatcattccctatccagacagccctatctgccatatttttaatattatcattttcaatatatgtattgataacattagctaaaaacaatttttctatatgttctttcctgtcggggttattctttatgcaataatctttaattaaaaattccaacgcttttcgataaccaacaccgcatatttcatttaatccaagttctttcgctcttgtagcttcacaatatattttatagaaacttggagataatttttttattttatcatcgatttttatttgagccacatatggaaaatactccgatattttaaaaattttatattgattattataagaccactcataatcgtatctaactgtaaaaataccattacactttttgttaggacattctgtcactagtaatcttttttgatcctccttatcagcaattataaatccttgtggtaccctaaacttagtatgacatattggacattcatctacaatcctcatatgctctttattggaaaattcttcatattcctcaaatgtatcaaacttttgtgttctcatatatattcctcctattgctctaatatgttttattttgacattacactgtaaaattccttttatttgcttataaattataatattatttttctcctatagtaattgattataataccaatcaattcatcatcaatagctattctggaattatcaaaactatcaaataaaaatatttttctattactatcatttaatctattaattacatctttaattacttcacttgattcaattactatatttccctctttcatttcatcctccaaatctattaaaaaagattgttaaaaacatgaataagtcgcccttgaacgttcgtgtttttcgatttgaatgtttgattatataggagaatcacacattcatttttaaatttctcttcttctatatgtctttattttttgacctcgaatgttaataccttcgaaaattaaacattcatatgcaaaaataaaaaatatcacctcacaaaatcacttaatgactttgaatattgatgatatttttctttatctaatcctatatataattctgtttcctgagtagttctatggcctaataacttttgcactgctacgatatccttaccactttcaacatagatcttgtaggcataagtttttctcatgctatgagctgaaatatcatataaaccaaaatattctcctgcttcttttaagatattactaacagcctgtactccaataggtttattaattcctttcctagattgaaatatatactcataatcctttttatccctaatgtattctttaaggagctttgtaactttaggtattacttcaactgtccttggctttctgtttttttctctaatattttttgaattctttttcttaccttcaaaaatagtaaattcacttctcctaagagcttcccttatgtctctggcttttaatttaactaaatcacctgctctatatccagtagttataccaactacgaataaaacataatcacgttcatttttatattttaaataatcctgaatatcaagaaccctttctgtatttgtaattggcttagcaggtcttttccttcccatattatttcacccacctcacctgatcctttcatcatttttaaaacattcttctatttcttttttagtataaggataataaaacaattctaatttttcacaattacttttatgaacacagcctttgcaatttataggcgatttagcacataaaactttattctctataaatctaatatttagttcaatcttctttcgcatgatttaacctccttacctataaaaaattgcataataaaaaagcacctaaaaataagtgctttaaaaatctaaaatgtcatctaaaaatcacaataggttattcctttaaccacatacagtatataatattttttgagtactgcataggtacttttcctgctacctttgtgatacctttcttgctaccctaactgctacctttatgataccttttctgctacccctactgataccctcttaagctaatttcaacttctgaaaagccctatctatggagtttttaatactttttcttgatttaaataactcttgtgatgctcgtgttatacttttcttttctataaatactttttgtataacttcagcttcatctatatctaatctttttaatgcattatcaattcttttattagcaatttcattaaaccttattttcttttccaaagtttctatttcattcataacataatcattatttttgcatttcattgagctttgaactttttcctcataattcattgctccaagctgctcaccaatttttaattcttcaactttcaacttcatatcatcaatttcaatttctcttagtctatataatgctaattccctttttactctctcgctcatgtttttccacctatcctttataatacttttatgttataatctagatagattgattagagaatcttctttccatgattcattctctaattgttataggtgttcattatgaacacctttattttttatattagtatcatgaattaaattacttgaatactttttttcaaatagtacataatataattggttgttgattatattattatttataaaatccattgtatgccccttaatggggcatattttgcgtttaataatagaattgcgtattaaaaaaatcgcaaattcaatctcttgaataaatgcgattttacaatacgttatttattttatcgatttataatttaagaataatgtgttattcaatataaatagtccatttcttgcatttattacacaagtatatagcgaaatctaatgtttcatccgcggcatctaaatcgaaagtgaaaattttttcttcttcaatgacccctatatctctgcgccagacactaaatctttctgcattacattccaggcactcagaatcacatctccctacatactcaaaatcatcaatcgttatttcgttatcctgtaaaaattgaactataacttcttcataacttacatctgaatgcccaataaaattctctaatttcaaaaattcactcatacgaaacctcccataaaatactgtacatgtcataaaaatgattataactagaatcatatgcaaattcaaactacaataacttatttaatgtctatcagaatatattaaaactcatatggtagaaattttatgaattttcaaagtatatattgactacctgctatttttaggatattatatattgccttttttaaatataaatctaacaattaaaaatgttttacatattataaatatcgcattattcaattttcaaagaacattttttttcatttactaccacgtcaaatctacattctgcatatttacttaataagtacacataataaaattattaatatttattgtttattctaaaatgttgaggtggctatgctatgaaaaaatttatacttatatttttaatttcaatatttttattatttaatctgacattctctacatttgctgctaacatttttaaagagggtatctataaagcagctgattttaatttttcagcagaaaatacctatagtgttcaaaatgtatctcaaaaagatagtgtttatatacttctttatgatgaaaatcaacttcaaatccaagctatacgactagctcccaaatctggaaaatataatttattaccacttaagcctgattacagaattgctatagttggtaatggggaggtatttatcgattaaaaagttacaccaatactactaatttggaaggtgatcttatattatgagaagaaatatttcagtaatattaattttaatatgtttattctttaattctcttgcattaattccagcatttgcggcaactacatttaaggaaggtatttatcaattgtctaatcttaatgttgcacaaaaaaatcgttatactattcaaaatgtatcacctgataatagtgtttatatcgcactttttgatgaaaatcaacgtcaaatacaatctatttatttaccacccaaatcagcaaactatagcttgcttgctcttgaacctagttatagaattgcaattattgggaaaggtgaagtacttattgcttaaaagacactttgtagtgtctttttgtttatgaacaatttctacacattccaaattactctccaatttactcatccactttatcatccttctgaatatatcccatttccctaagctccttatttaaagcttctttaatatctagtccttcctcttccattctcttttgtactcttggaaccactatatcaactatatctttaataattcccatccttatagctcctttttaggaagagagctttaattgactctcttcttatttatcttttgcagtaaccttaacattaacaattgtaatccctgctaatatgccttccagtcctacaaggtattaatgaatatctctaattatattttcacatactaattttagcgatttaacttacactctaaaattgagaaagagggcttattaaatgaaaaaaatatttattatactttctgcgcttttacttttatcttttagtatgaataatctaacagtcagtgctagaacaataaatatccagttatctgaaggtatttataatataagagatttaaaattaatggagaatactacctacaatattcaaaacacttctgccggaattaaccttatgataagaatggatggtcagcaagaagtaatggaatcacaccgtttattagaaaactcacctaaatacaatattggtcctttgaaatatgttgatagaattgtaatattaggccctggtactgtaacaataactgaataaatattttcaaattgcacataatataatgatttcgctaacatattatttatataatccattttggccccattaattggggtttttttaatgtgcaaaattatttatcaacatttagaattatttgaaattggtcttcatataattaaatgtagcttcttcgttataactttatttctcttttatttactcttttatccataatctttttttgcttttacccagtaacctataagcccctttttaggggcttccttcatgttgtccaccaattaattacatagcatttttcatttttatttctttaagcttctttactgctttgtagtaaaaggctgtctgcttaccatcccaattaacatttaaggtttcaccattgttataaattcttactaccttgcctatatgctttgtgcctttatactttatttctaccagttcattttcctcaaaatctataacattatgagcaaaagttgatggcttaatagtgcttttcttctcatcaatatctgtttttgcacttaaaatatgcaagcctatattttctttaggaacctcaattttatatacttcatcttcatgatattttggtttttgtaagtattctaatatccatcctttaggatttataacaattgtattatcttgcttttgaattattatattagcatcacctttacgtttaatatattctgcaacatgcatgcctttaagtttttcaagctgcatatcatttaattttctatcttgatttacaaataaaatttcatcagctggaagcagatctatatcttttcttaactccaattcttttactccatcactgttaaagtacagtgtcttttcttcaagctctacaagcaatgctccatatattcttttaactattcttgctgcatttggtttatatagattaataatttctgcaaatttatctttatgacttttgactattggtgcatactcttttttaggctctttaacttcattaagcactaaatcaaatatgcttatttggccatctaaaacttcatccattttatttttaatcatcgttatcccacccaagcagcttcttttctaaattgtcatagtcatagtttcttggctcgaaattattaaatctgagtggctgcacctctttattcttagctatcttaactggattttctttgtctacataattgccttctaagatcttaataaaattatttggctttactaaccaatcaaaggttactgtccagttcttattattttgaccttttaagaaactgctgcattttatattttctatagcttgaagtattttatcttgtccatattctttaagccttgcttgaagtaatttatatctgttagtgcctttgtttatggatatgagcttttggagtccaagttcattccacttatctattatgggttgcactttagtgctactaactatatctttagatatagtatttatattattaattgtattattaagtattgtattattatcttcacagttttccgaataccctctgtcgatatctcgagtacctctatcgatatttcgaacaccgcagtcgatattccgattaccccctatcgatatttcgagtagcttaattattctattttctattgcttttgtgccagctttgtatttataagaaatgcttaaaaatccttttttctctaaagattttattatttcactacacctgtttttagataagccaaaaaactctgcaaaatagtcattagacgcaaaacatcccttttcattatctaagctatctatttcaactaaaaataatttttcattcatagttaagtgagtattcagccaaatttcttttggtatccatatgcctttaaaatctctttccacagtctcgcctcactttcattatttgtaattttcattaactaaaaaacttagctgcatctacttaaagcaacacagcaccttttacatatttcaataaattcttcaggtgtagtctttttattaaaacttgtcctattaaaccttatgtcttctcttgtcatagcaaaaataatattaaactcttctttgctgacttttgattttaaatcatttaagaattctaaaaccatttacttttcctccatttcaatttataatggagatacggatggcattccgtatccctaaaacttgtgaacctttaattaaggttctttttttatttataaagttcatcttctttcatgtttttatgttcataaaaatcaatacatttttttgtattcacatcagtaaattcaacatataaatctccacattgattaaaacaaacttctccaacagttactgtatagatatcattaagtaaatcattttcaactgtaatagctccatcttttatttgcttccacatacgtctttttctttctggagcatacattattgtgtattcacatttttcagaatcacttttaagaacgtcatagcctattttccataagatttctattatattcatcttctgaatttctcctttaatatgtttaaaatcagttaatttgcttttaatatctttagagcattatttaaaacctgaagtcttagctctggaggacacattttcataacagcagcaacttgtaactctgccataagctcatcaaagccttttttatcttctaatcctataatggttacctttaattcatcgcctttcatatccattcccccgtaaatataaatcatttcataatatgttttcttatcacaatgtgttacctagcaaactttatagttataattgcacataccatttcatcaagtgttttcattatcatttgccaatcttctttttcatcttcatcaacttgaccatcacgtgaaatcttaatcattaatttcttaatgctctctagatcttcaagctcatctaaaaatgttaatactgcttcagctaaatgtttaacttctatctttggaaaaagttcttttcctatcaaagtattttgataatgctgcaaaattaaatatgggcgattatatatcttagccatatcaattactatgttttctggtggtgttctcttccctccttcatatgctcttaaactatcaacagatatatctagtagttctgatgatttttcttgagttaagcttgtacattctctcgctatttggtaaatatttctgtagttttctaccatttatttccctccttattcttgataaaatccaattatgacttaaaagcatagtttaatctaaaaaaatatttattatttgtctattatctaaatttaaaatcgtttttaattcttttatttcttctaatgaaaatggaattatcccattttcctttttgttatatgtactttgagatatttcaagctctcctcccaaatattcttgactaaagttagcttgttttctcaaaacttttaattgatctattggcatttctcacaccccctttatgattttaagtcatatactatactctaataataatgactcaaaatcataatgtcaatggtttttaacaaaaattattctttatagtcatatttatagatttgaaatcatattcagtatacaatttaaatgaggtgataataatggcaacatttgctgataggttgaaagaagagcgaatacaaaaaaatcttacacaaacagaattagctaaaacactatatttaggtcaaacgtcagtatctaaatatgaaagtggtaaacaaattccagagatgcctactctgcaaaagatagctgatttttttgaaatatctatagattacctcttaggaaaaactgatataagaaattacactgatgatcctaacatcactattgcacttcatagcgatactgattatgatgaacttcccaaagaagctaaagaagagattaataattttattgagtatataaaacaaaaatataaagataaaaaataaggtgttctttatgaacatctatatttttaaatatagattgttatattttatcaaaatatcaatataaaaggagatttttattatgctaatttttattatactagctctaattataacaatatttgttattaaaaaatctaaaactaaattgcagaaaacactaaatgaaactgtatctaacttaaataaaacaataagagaaaaagatgatataatatctgaactttctaaatatcaagatattatcgacgtacaatcaaaatgtgatgaacttctatctactgctcaaaatgaagcggagttaataaagaaaagatatgaaacattattaacctttgctcaaatagaagctgaaaatattaaagaaaaatcattatctgcaaaaaagcaaatggacgaacaaataaaaataagaaaagtagaatatgataacattttatccactgcgctagaacaaagtaaacaaataatttcagatgcaaatataaaagcagaagaaattgcaggggatgcttacaaagctttaaataaccataaagagttggaacaaaaggccaaggcaatgaaaaatgttatagagggttatggtaataaatatattatccccactcatggaatccttgatgaacttgcagatgattttggttataccgaagctggaattgaactaaagaaatcacgacaaaaatcaaaatttatggttgaaaacggactagctgcaaaatgtgattatgttgaaaataatagaaagactactgctattaattttgttactgatgcttttaatggtaaagttgatacaattttatcaacagtaaaaagtacaaactatggtgttttaaaacaaaaaattactgattcatatatacttgttaacaatttaggtgaagctttcagaaacgctgtaattactccagaatatttacaagctagacttgatgaactaaaatgggctgttgctgcctttgaattgaaagaaaaagaaaaagaagaacaacgccttatcaaggaacaaattagagaagaagaaagagctagacgagattatgaaaaagctataaaggaagccgctaaagaagaagagatgttaaagaagcttatggaaaaagctcagttacaattgcaagaagctaacgatcagcaaaaagcagaatatgaatctaaacttatagacttacaaaagaaattacaagaagctgaagaaaagaatcaaagagctttatctatggcacagcaaacaaaatctggacatgtatatataatctcaaatgtcggttcgtttggtgaagatgtttataaaattggtatgactagacgcttagatccactagatagagtaaaagaactaggtgatgcaagtgtacctttcacttttgatgttcatagcatgatttttagcgatgatgcgccaaaacttgaaactgaattacataaaatttttaacaaaaatcaagttaataaagttaatcctaaaaaagaattctttaaagttaatattaaagatgttaaatcacaaatagagaaaatgggtattcaatcaaaatggacaatgttagctgaggctaaagagtatagagaaagtttagccattgaaaatgaaatgaaaagttctgaagaatttgccagttaataaaaggtgttcattacgaacacctttattttcaaatatatatttgagtaattatataactatttttgaatggggcgattaataatgaaggatttgcttaatttacttgtggaaggcaattatactctgttcattgtattagcatcaatgattatctttgtctggctatttaaagatataaaaaaatctttacttgaaactaaaaatcaggatttagattttttagaccagtcaattaattcctatgcacaagttttaaaaacaatatatttctatctaaacaattctactgatgagcatgatttaataagcaatatgtatttatcatataagtattttgataaatctattatagaaaaaatagattattttacatctcatagttttattatgactccagaaaagaaaagtcagttgcttacagaactatcaaaggaaataaaaaataaattacaattattaaaaaacaaacaattgcactctattatagataagaattatgctttttcaacattggaaatatttgacgcattgaacagaaatcattttgatgtatattgtaatgcctttatatattctatattaatttttactgtttctcttattttgctaattattagcctaaactttctcacgttaaatgctctaaatgtaatactgcttattatatatgtacctacatttattttttggctgatttcaattttaatttctatcgaattattacttggaaaacattacaaaaggccgctactatttattttatttgttttcttaccagttatattgacttatttcattgtagtttgcccatattccataataaaactatttcttgtaattatttttagtacttctgtagttgcaagcttttttgtaaatgtaaaatattcaaaaaggattcgtaataaaaactaagattactctttatcatgatgctgattataatgatctttcaaaaaaagctaaagatgaatattaatgattttattgaatatataaaacaaaaatataaggataaaaaatgaggtgttcgttatgaacaccctattttcaataattgcatttaataatttttaactcattatcatttatattctaattctaaatatatttttacatttcatttagaataaataatttctgcctttgttttttttatgaactttacttctctttcctcgcaagtatctagcaaaattatatctaatacaatatcacattcttttctccaatattcaatcatattttttcttaagttaataattgaattaatattattatattttttattatatatgagtataatatcaatatctttgaaactgcttatagccttgatacttgatccaaataaatataaagaaattccattaaatttttcgtctggacaaagtcctatcatcatgttttttaggttcataatcaataaattcttgtccatcatagtatattgctcctaagaattctttgaacttaaataatcctatgttcttttctttcgcttcattctttgccatactagtatacttattccatgcactaactgtaacaatacaatctatacttctattctcaagcaatatttcattaacatcagcttcgcttactatataaatattagtcaaatatactattaaattagatttgcctaccctaatgatttttaaaatttgttggtccaattcttctatatctgaaacaaatgaattagctgatacaaatttaattaaagcctttacactttctggcctaggtaatttttcatattttcctccttctggcattgtaagttacctccttaaaatattgttaatttctgttggaaatattggtgcatatggattaggttcatcagatatttgattatactcaaattccaatacatgctctctaaacatttcaacaacatttatttcatcctgattaataagatgattatttttatcaagtaaattaataatttttttattattcgggataataatatttatggctttttgtttccatattgcctctgcagtcgttaataaattaatagaatactccgaatgagggccgtattcttcaaatattatcctattttgtgctaacaaactatcaagtattttccttaattctgctgcagatttatataccggctcaataaagcataattttattttatctatatgatcttttttccattttaataacatttcaataggaaattcgtccggattcttatctattaatgtatgacacgttggacaaagaagaattatattatcaaattcgtccctcatcagtaaatctaactcattatttcccctgggtccttttttactttgtcctataatatgtgcaagttcctcaatgtttgtaattttgccactttcaaagaatttatataattctttgttacatcttggattttggcaaaagccacccgaactaaaatatagtaatttctgtacttttgaatttatactcaaaataccatccctttcaataacttaatataaataattaaactttttgagactctttaatcatttctataagcttttcttttgctttttcaaaacttccatcatcatcagttttcctagactcgcattcccctgtatccgtatccgtatcacgctctcttgtgttattgattaaagttgaaattaatttttcaaatctttcattattcctattttcaagcttcacatatatattcgcaaacatctctttacacaaaactccaaatgatatacatattataattaatcctaaaatagtcacacttgataacttataacttgtgctattatcaatctccatggtcttactatttttatcatctgcgtaatttactttaaattcgtttttttcatctaacatccaaacaattacttttaattctgcattcttagacaatctttgtaaatttaataccattcttttatcacttatcgtacattttgcaacttctgtactgtcaagcttataatcacatatcttcccatcaacatctatatcaatattcaagttatttgatggcatagctccatcgttttttattgttataactcttgtgcaatttgatatatttgaaagtaattctgaattattatttttaagatattctttcaacttgtcatttgattcattttcaaattttatagtatccagtgttaatttaggtccgctaaatctatctacaatattattaccaaaaagtaaaatcaagagtgatataattaaacctcctattgaaactgctatcgctacattgggtttgtctttttttaaagccaattgaacatccccccatgtttaagtcatgaacaatccactctttaggtaaatcctctttcatacaagtaaattctatatattgaagtttattttctttgcacttttttgctacataatctctaatattatatattgcagatgcctctatgtaatcaattccatctattgctaatattcctgttgaattttcatatctctcatcactgtacattgatagaattaatgtaataataatttgtagcaatctattctctcctaaagatgcactcttaatatttcttctattcagaaattcattctctaacttataatggttcataaagccaatttcattacacaaattttgaaaatcattttgcaatttatcattaatcttataaaatttctcatcacaactcatttcaagctttttatatgcctctattgatgccttcataaaatttttatcttcaatatttttctttcgtatattcaaatattcaccatttaatatattttcaaaagctttaatattactatcttctatattctttaattcatggatttgctctcttacatttaacatatatgttgtcaacatatcatatgagctttcactatctttaatttcttgctcaaaaacttttattcgttcttttgattttcttaaatatccaacatttattcctagtattttctttattgtatcagtcttatcactatatatcttaaattcaggtataaacgaatattttaatatctcagttgctgctagtttatcttctccaaaattaaacgagggttctaaaatactattataaatttcatagtatgaatcactttttactcgaacttcttcgttaattcctccgctaaatattaatttatttgaaccaacatctcttttgaccctaaactctatatttttgacttcaaaatctatatataagttcctaaaatcaaatttatcaacaggaaactgcttttccagtcctaatatatacattattgaattaaacaacaatgttttacccgacatatttcttccagtaataatattcatacctttattaaaaaatatactattatcaccaatatttatcttttttaaagtgattttattcaaatagttcacatccttataaatatttaaatacgatgattatttataaataatctatattattatcttattatattttgtatctgctaatattcttttatatgctaaatacattgttatttaatatattaaaattcaaaaaatatatacttattatagcatattttgtaaattatacgctatattcaattcaaacactttacatttccgtcttgaacatacgttcttactgcattataataatatcattaatactgataatggcggtgattgactaatgaaaaaattaaatgatattttttgtattattgagaaagaaaaaatacaccttgaggaaagaaatcttaatcagtattcatttaatggaatttactttaaagctccagatcttcctccagttataattatagaaaaatctattgttaatgatagatgcaaatatttatctattctcgctgaagagttagggcatcactttactagtttagataatttaactattcaatctagaaattatcctgaaaaacttatgaagaataagcaagaacataaagctaaatcatgggctgctaattttcttataagtgatgatgaattccttcaagcattgtgtaattgtatatctactccatgtgagatatgtgatttttttaatataactaatgaaatgctacaatataagattcattctatagttgttgatgaaaatagatataatcatataagatcttcattaaagagaaaggaagtcccatataatagttgtgaaatatagtatttttcctactactttttaataaatatatgtagctatactcaattaacttaacttattcataacactacaatcagtgtataacactttggaggtatactatgaaagcagctatttattctagaaaatcaaaatttactggtaaaggtgaaagtgtagagaaccaaatagagctatgtaaatcttatgctaaaaataacggctatgatgatatttatatatatgaagatgaaggcttttcaggtggtaatataaacagacctgaatttaaatctatgatgaaagatgctgcagctaaaaagtttgatgcaattatttgttataggcttgatagaattagcagaaatgtttctgacttctcaacgttgattgatgaattaaaagtccttggcattgattttatttcaatacgtgaacagtttgacacttctagtcctatgggtactgctatgatgtttattagcagcgtatttgctcaattggaacgtgaaactatagctgaacgtatcaaagacaatatgtatgagcttgctaaaactggtcgatggcttggtggcactcccccttttggtttttcttctgaacctatatattatttagataataattctaagcaaaaaaagatgatgaaattatctcctattaatgaagaaatttctctagttaaacttttatttgagaaatatttaactcttggaagccttggaaaacttcaaaagtatcttattcaaaatgacattaaaactaaaagaaattctgcttgggatataaaagccttgcagctcttacttagaaatcctgtttatgttaaatcttctgagcttgttataggttatctttcagtcaaaggtgcaactgtatttggtgatccaaatggtaatggaatattaagttacaataaaaaagattctaaggataaatataaagatattagtgaatggattctttctgtttcaaaacatgaaggtgtagttgatgataatttatggattaaagttcaaaggcaattagataagaataaggatcttgcacctagacttgttaatggcagcgaatatggtgtatttaattcagtgctccattgcgctaagtgtggtggaaggatgattcaaaagcaaggtcacgtttctaggaagactggagaaattcttcgttattatatatgtataaataagattaacccaagtgataatacttgtgattctaaaaacataagacttgataaattagaaaagagtgttatgaaagaactctttaaggctacagatgataaaggctcacttattaaagccattgaagaatataaaaaatctttagaatctgaatctatagataaaagcagtattaaatcatatgaaaaacagatatctcaaaaggagctgcaggtaaaaaacttaattgataagctttctttaaatcctaacatatatgatttactttcttctagaattgaagaattaaataaagagattaaagaattgaaatttaaaaagtttgaattagaaaatactaatagtaatttaaaagcagctattaaagaaattaatgcttctacttctatgcttttgaattttaaaaagctatgggaaaatgctgattattctatgagaaagcttcttataaattcttttgttgattatatttcttataactcagatactcaggaagtagttataaagccattttgcactaataaaaaaaaaggcgctctttaatgtagcgcccaaatgcacctgcagttgcagcaaaatctatattatttaccatattgacatctgtttttgggttaatattattgtgtttcatagcatattcaaaagccatttctggaaccccaccaggtcttcctcctataatattttttcctttaatattttgccacttaaaattatcttccttagttcgtccaaccacgaaggaaccatctttttgggtaagctgtccaaaaagtactgggtagtcttctcttccttgattattaatgtaaatagtttgttctggtccacaaaaaccaatatctgctgatttacttaaaactgcctgcatagttttatctgcgccttgacctgtttgtaaatcaatttcgattccattctctgcaaaatatccttctttcattgcaacatacataggagcgtaaaaaactgaacgtgtaacttcatttaagcgtacagttactttaccttccttagttttattattgctactacagccaaacatagatatggcagttatactcgaaatcaataaagcagttaatacttttaacttttttttcattaaataaagcatctcctaatactgttttatgatgtatcatatgatatttaatcaaagattgttctaatatatgcgctctatttgctggatacaataagtcttaatttatataaactatttgggctttaaaactttattttgtaaacaattcacatttaacaattttaacttaaagcaacgcacgaagtataaacttctaaatttaattgtcgatttttaaataatatgataatataatcatatcgtttttataaaaaaggtattttatccacttatcatttctaagaacaatatcaacaacattaaatgtatagaaaggggaatttaatatgaaactatggtccattatagcaataggagtatatttacttattttgcttacaataggatactactcttacaaaaaaacatctaatctttcagattatatgataggaggaagaggactcggacctcttgttacagcattatcagcaggcgcaagtgatatgagcggttggatgcttatgggacttcctggagcagtttacctaactggtatatctaatatttggataggaattggtttaaccgtaggtgcctactttaactaccttctactggctccaagatttagagtctacacagagattgcaaatgactctatgacaattccagactatttagaaaatcgttttaaagataagtctaacatacttaggcttgtatctggtatcgtaatacttgttttctttattctttatgtttcatcaggacttgtggctggaggaaaattattcgttgatacatataagctaacttatacaatgggtgtagttgtcactctatctgttgttgttctttatacgtattatggtggattcttagcagttagccttactgacttcttccaagggactttaatgtttatatgtttaatcactgttccagttgtagcgtatatgaatataggggtagatcctggaacatttgtaaataaggtaaaagcaattgatcctaaattatttgatatatttagagggactagcatagctagtattattagccttctagcttggggcttaggctattttggacagcctcacattattgttcgtttcatggcaataaaatctgcaaaagaattaaaatcagcaagaagaattggtattggatggatggcaataggtcttttaggtgctgttgtaagtggtattataggtcttgtatattttactgaacataacactccattaactgaccctgaaacagtttttcttcgacttggtgatatattatttcatccatttattacaggaattatattctctgcagtactagctgctattatgagtactatttcatctcagcttttagtttgttcaagttctattacaaaagatttttatctagctttctttaataaagaagcttccgaaaaacaacaaatggtaataggtaaattagctgtattagtcatagcagcatttgcgacagtacttgcataccttccaaataagactattttagatattgttggccaagcatgggctggttttggttcgtcttttggtccagttcttttattaagtctgtactggaaaagaatgactaaatggggtgccttatccggaatgattgttggtggtataacagttcttttatggattgttttaggtttatctagttttctatatgaaatgattccaggattttcattatcacttctatctgtaattatcgttagtcttttaactaaaaagccagataatgatgtcagtaaccagtttaataaaatggaaaatatattaacagatatgaaataatatatttgttttctaaaggtatagtattcaattaatcttgtacctttaacttataaaaaataacagtaagactaataattccatggtcttactgttattttttatccttatttgcttattttaaattttgatactaactcatttaatctgtgagccaatttagctaattgattagctgaatctcctatttcgtccatagtaacagcctgttcttcagctgatgctgatacctcttctgttgctgatgccgtgtgttctgatataattgatgtttcttgcatttctactactgtatcttttgctgttttaatcatagattccgtagaattatatacatctcgaactacatcaaaaatgtttcttattgctttttctatattatcaaaatgagtttcagcctttaatgccgtttccataccaacagtaatttcctgagaaccttcatccatactattactaatagtctcaatttgattttgtattccacttattaaagccgaaatctgactagcagcagtagcagattgttccgcaagagttcttacctcatctgcaactacggcaaatccctttccttgctctccagctctagcagcttctattgctgcatttaaagcaagcaaattagtctgacttgcaatattagttataacttcaacaatcttaccaatttcatttgatctgtcaagtaacattttactttcttccaaattggttttattattttcaacaattagcttcatactttcaacagctttatccaccgcttcaaaagcaaccgcacttatgttatgtgattcttcagcagtttcaagcatatcattacacttattaacaacaattctacttacttcttccatttcacttgttttctcgctagctaaagtcacttgtcttgactgctcagttgtattttctgctattacttgtattgctttagcaacttctccagtgactttaatactatcatcacacgagtttgcaagattagttgaaacttcatttacctttgatgattcattatttatatctgtaattatgcctcttaatgcttctatcgtatgattaaacgctgtagcaagatttccaaattcatctttggattttacttctattgaaccacttaagtctccagtagatataacttccgcgaactcattaaggcgtactaaaggtttgatcaacttagttgctgctgtaaatatagctgctgataaaattactataatagctataactatcccaatcataattagtatcaaatgattagacgaagcaaaaagttcatcctcataaacaacatttataactgtccacccagaaatcggtgactttgcatagaatgcaatttttttctcagatccacttccaaatttaaaaactcctggtttatcaccttgaatggcttcattaagtttagtaagatctgaatcgttaactgtatttattttctctttcatggcccaatctttatttggatgaactataaaagttccgtcacttcctaataatattccgtaacctttttgaccatattttagatttttcacttgattttctactgcttcaatagccaaacttgaggcagctccggctgtaacttttccttgtgcatctttattccatgcaaccatcattacaacattcttatcataagcttcagaatatgtaggcttaaatattgcatcataaggaacgccatttgtctttgaatatctttctgaagcttctgttgcagcacctttagcccaattagcagttgcaaattttccattgcttacattataaaatctcgcttgtagcttattcaaactatcagcgttactccattcattaggctctaggctatttagtatatgcactgctgcatattcgtctggatatgtatttttaataaaattaaatcttgataaatttaaatcatctattatatttaatgatccatctgtactatttaaatttaaaccaggatttttttccaaaacttgtttaagcactgggctttgagctgtttcttgaacttctgccattctactcgtcagccatgtattaatatgaccagttgcttctgttgttcttaatgacatggaattcactaattcgctttctatgatgctcctaaaattaatatatgcaaatcctgtcagcgatagcaatccaactattactagcggcaatattattaccattaactttgatttaaatgatattctcatgattaatcatttcctccttaaggtgtacaaattttttaatcttgaaattcaccgttatgcaaccatatatgttttaattcttcctgatttctatctaatgtttttctctctctcatagcctttgctggtatacccgctaccaactcatttttttcaacatttttaccgactaaagaagaagctgctactattccttgtttttcaattgttactccaggcaatatagttgaattagaatatattttagcgtaatctttaattactacttttgcatatgtccttaattcatgttcatgctcctcatgagaatgagtaaaaattgtaacgccttcgccaattcctactgagttacctattgttattccaccttttgaatctaggaaagcacctttgttcataaatacgttatctcctatttctatattgtcaggaacattgaaacgtacattttcttcagctataaaattctttccgcatgacttaaataatttttttgctaatatctgtctataaggaatagcaaaattggcaattaagcacataggtgatttatctagtacatcccataaaaaatgaagatatcttttttcttctgaaaattctaattcattatttttaggtaaatagtccccatataatttcattttatctaatatttcgtatggaaaataacattttagagaatttaaaatttctattacgccctctttatttatcccttgttttactataacttctacttcgtttaataattcgtctattttactcatatcatttcagattattaaaatcgcaaaaaataatcttttcgcctccttcatagtcaaactttcaacgcgattttataagcaacattaagtggaactgtttgtccaaattattttagttttgctactaattactatgattatattttattatccttctccactcccttctgatcttttaatattatttataattcaaacttcgaatctctagcagcaaatactttgcacatgaaaaaataataaaaatagctttcttattgtaagttttaagagcacaaaaatggtgtctacataattgtggacaccaaaattaaaatataaaatttattattcatagatacattttggcaacctgacaatcatagaaaattaaatttttccttagactcatagctttgcgaccctatttttcaataagtgtgcctattgatattatatttttttcatttttattctattattacatcttttacaacatttttcaacttatatacactaaatttaagtcacaatattgtaaaaatggatatcatttaatcgtttaattcaatataataccatttattcaatagtatatatttataaatttaaatatattatatatttttttcttatcgccatgctaataaattcatttaaaaatcaataaatttttcaattccatatatactaattcatgaaaatatatctcctaaaattatttttttatagaatttactttttaagttctgtatcaaactctcttcttgtccaagttttaaaatcagctggattttcttcattaattaaaaatactcttgcaccacgaggaattttgtcatctccatatcctccgtatccagtatatccagcatatccaagcctaacaccatctaaagcagcacagtaattattaaaatgatcatgccctacaaatatacctttcacatccccaattttaactattttgttaaataagcataaatttatcttggcacagctctcatcttcaagcctttcaccatttactaatccagtcttccatgccttttcaaatttctttaaaggtatatgaaagaacataagcgcaggtattaatcttttatattttttcttcaaatttatcgctgttcttttataccaccatatttgagtaagttttatccaatcatatcctccaataatggtaggagcgtattttcctgaatctatcatatatatattaaatttaggcgttttatcttttgaactttctacaagaagattataattacctatcctatcaaaagttttataccccacttgactcagattatgtttaaagctcatatataaattcatcatttcttctttcgtcatcatattatgttcatcatcatgattaccaaaaactatacaccaaggtacatttctattttccattggctccgctatatgatttatagctttttttacatcttctgctgtctgacatttgccatcaataatatctcctgataatataaccatattggggttttcgtaatctaatatcttattcataagatctatagatttgtctctgctcggtccttcatgtatatctgtaaattgaactattttaaacttgccattactatcaaacctaaggttatttttcatatatattcacctttcttaaaatataatattatatgaaaactaggttgtatctgacactaactatttgctaattagaccttattttaaattgtaaaaggatcattgcattttgcaacaatcctttatatcttataaaacattaaatatatattttttaattaaatttctacatttatcaattaatttatcacttggctcactagagtcttaaacgtaaatttattattacaacatatatatcataatgattttatatctttatagcttaaattcttcaatcttttctttcaattcctcagccatatcttttaaattattaaaattaccaacaaagctttctgttgacgctgtcacttcttgcgctgtcgctgaaacttcctctgttcccgatgctgtttcttctaatatcgctgataagttttctactttttcaactacatcatccttcatattatttatggtgctcacaccttcagctattttactcaccttttctgttaaactttctatagctgttactatttctataaatatcacttctgattctttaactgcatgctcttgatcatctactgttccacttgtttctaataccctgtcaactgctaattctgatttactttttatttcttttattatttcatctatttgtttggctgaaactgatgtctcttctgcaagctttcttatttcatcagcgactactgcaaatccctttcctgcttctcctgctctagctgcttctattgctgcatttaaggctaaaagatttgtttgctctgtaatcgcacttattgccttattcatggtgcctattttcattatactttccgaaacttcacttacaacatcttttactgattcagtactttttttagtttcatatgatttatttataacggtctttacaatctttattccatctttacctaaatcatttgcttttattgccataccatttacactttcagtcgcttcttctatcttattcatagattgagatagtaagtccatgctgtgtgatatcatttctaaattgttagaagactccatagttccacttgatatttgatttattgtctcacttacctgattcatcgatattgctacttctttgctcatactagctgaatttatagcatttttattaacatttattgccgaattatcaacactcttaattaattttgcaatatttttctgcattttattaaaactattttctagaattataaattcgcgaatatgattatttataataatttctttgttaaattctccattcgcagttctttccattccatcttttaaggaatttactcctttacttattcttctagcaatagccatagttataattaatgtgattatcgctattgcaaatataattataattgatgctatagttgaatcattttctgatttccttagctcactagatgggatttttagtattaacttccatccagtaagttccgaggtctcaaaatacccctcatatgtactattattataattgaatttgattttacctttatcaccagttgatatctgattccagcaattgtattcagttggctctgttccagcaattttagttttgtcattgtcagaaataactacaccatctttatcagtaataataaattctccggtttgtccgtattttatacttgataactgatctgctagttcacttagctctacatctatagccataacgcctatcggtacattatttttaatcacagccttatatattgttattgcgctttttccagttattttatcttgataaggactatgaataatatatttatttggattctctatagtctctttaaaccaggatttttctgtagcgttataatcatctggcaatttactatcaagtatttggaatacttttccagtattgtctgaataatatatatttaaaatactttcatcagtcttcttaattaatttcatatctccattcaatttattatatggtgattcttcaatattaaaattattattctcaattaatgttttcaatgtatcttcataatatgtaatcttattatttattatttcctgtcctatatttgagagtaaagttctattttcatcaaaactcttttcattactcctccttgatgtcgttgtagaaatgatacctaaaataactactggtattattgctaacatagcaattgtaataagtaagtataatcttatacttactgatttaatttgactttgtgctttatgcatattttcccccacctcataattaacttcaattcatattatatcgcaaaatatgccaaaatatctcattttatattctttttatgaaactatgctcaaaaatgacattttttttgacattagtcatatttattagcaatattttaataaatcatcttatttattatcacattcccatttaaattgacaaatttatatttatttttgatagaaaaaattaaaaatcaacctttttaggttataccctcaattttactggaatataatttcctaaagaagaacaaaagtggctgcgccacgctctttctttataccattttttacaggccaatatccttataaccattggtatcactggctttcaaaatcaaaaaattctatactttcctagacaataaaaaaacaaaatccaagttatattagtaacctggattttgctttcactaaattcttatacattatttattattatgtttctacatatttaatcctgaataagcttcttctccgtgcaaagaaatgtctaatccctctgcttcctgttctgaagtagctcttaagcccattactaaactcattactttaagtattacaaatgtcgcaactgctgcatataaggcagttgcacaagtagaaattaaatgagcttttaaaagcgcaaagttaccatatattaatccatcactccctgctgaattaattgcctttgatgcaaagatagccgtagctatagatccccaaattcctgctactccatgacagccaaaagcatctaaagcatcatcgtatcctaatttcctcttcaatatagctattgcgaaaaagcttaatgctccgccaactgctccaataagcacagctgatatagggctcacgaatcctgcccctgagttattgcaactaacccggctatagctccacttactgttcctaaggctgtaggttttttatagagcaaccattcacaaagtacccatgcaactgctcctgcagccgctgaagtattagttgtaaagaatgcatttacagctacataattcattgcaagagcacttcctgcattgaatccaaaccatccaaaccataaaagccctccacctaatattgccataggtatatggtgtggttcagggatcgctctctttcttttaccaacaacaattgccgcaacaagtccagaaactcctgagtttatctctactggatttcctccagcaaaatcaaggactcctaaattctttaaccatccattagctccccatacccaatgagaaatagggtcataaacaaatgtactccacaaaataatcaatattataaacgccgggaaattcatacgttcagcaacagaacctgaaattacagctgcagtaatcgcagaaaacattaactgaaatactacaaattctaaatgtggtattgtgcctgcataatccgcattaggcgccattcctataccttttaggaaactccaatctaaaccacctattactccttttacatctggaccgaaggctaaagtataacctataaaaatccattgtaaagatataataacaagagctgcataactatgtactgtaatacttaatacatttttgcttttaaccatacctccataaaataaagctaatcctggcaccattagcattactaacgctgcactaataattacaaatcccatatctgcgccgtttaataattccattttctattcccccttgaataaatttaattaaattttaagtacaattgcttattctaagttgttaaaaaataaaaaagacgcttcactccaaagaaggtatacccatactagatatatcttttttgaaatgaaaacgccattgttttctacatatttctttaaatttttaaattacttttataagtttactatcccatgttttatatgtcaatataaaatgataatttattattagttatttttaaatatgaattatttttttcattatacatacatgccaaataaaataacaaaatctcagacggctgttaaccaaagatttttaggcagctgcttttttaagcgtatgtaaaaaaaccctcttgtttttacattaaatcaagagagttctaattaaaaattaaattcttatatacatattattgattaatttctatatccacatgaaaaatcttctccaggatttatatctaatacaacacgttcgggttcaacaagcgcaacttcatgtcgacatttccacttactattttccgtaattccttctatggtgtctatttcttcaagaacatcgctattttcaaaaatgtaatatccataagaatataaaatattcgatatttcgcctggatctaaatttttaaaatggcattgtaaatcacataaacctactgctgataatcctaatgtatccattacatactcattctcattattttcaatgttaaataatcttacatttaatataccaattaaaacatcataatcatcatctagaggattgttttttaaatactcttccctacttattacttgttcagtaatattaaaatgaatgccttcacatggaattaattcaactatagaataaagagttttttgaaaaagttctattctttcagcataatttaatcctatagccattatatctgtaaccaaaactctaacattacatttttcaaattcttctttattcacatagtcaaatgattgtcctaatgattttctcaatttattaatttcaggcttttcttcaatgacgctaataacaattccaacaggcgcatttacatttttatattctaatatatgatccataaatgcaaatgaaatattgttatctctattagatgtaactttaacatttttaaaatacttttgtatatttcttagtaattcattttccagaataacaggcttttctttcatcaaaagttcaacactatatatttctgaaaaagcatcagctacattttctacctttccatttttacttacttcatatcttttcattctataccaaccctctttcttatttttaattttaattgaaataaattctttattctttgctccaaataaaaaagctgcctcaaaacataattaattttgagacagctttgtctatgtaaatatttattaattataacacactatatataaatttaatatacattcacttaaaatgtatgtattattataattatttttatattttcatttaatttgaaaattaattcattcacaaatggtttggtaaatccataatattattaatagtatagatatatttaaggagaaagctatgcccttaaaatacaagaaccacatagactttgataaattacccaaaaattttcctccacaacatcaggattgtcaaccaggaattgaagcacgtatggatccaccgcctatatttgataatcctgattataaaggaagtgataaattaaaaggtaaagtagcactaatcacaggcggtgatagtggaatcggaagagccgtagctattgctttcgctaaagagggagctgatatagtaatttcatatttatatgaacatcaagatgcaataaaaaccaagcaatatgttgaaaaatatggcagacactgtcttctcatgcctggtgatatttcctacaaagatttctgcaaaaaactagtcgaatgtacaattgaaaaactaggaaaaattgatattttaataaacaatgctggtgttcaatttcctcaagatagtatagaagaaatatcatcttcccaattaaaaacaacatattcaatcaatatatttccaatgttttatctaacccaagctgcattgccacacatgaagagaggaagtacaattgtaaacacggcttctgtcacagcttaccaaggtagtaaaactttaattgactattcttcaaccaaaggcgcaattgtaaccttcactcgttctctttcccaatccatagtaaccaaaggaattagagttaatgctgtagctccaggccctatttggacgccacttatagtatcaagcttttctgctgaagaagttgctaaatttggatctgacgttcctatgaaaagagctggccaacctttcgaattggctccagcatatgtatatcttgcatctaatgactcctcctatgttactggacaagtacttcatgtaaatggtggaactatggttgatagttagaataaatttaacaaccgaatatattctttagggcacaataaattagggctttttaacaagcccttacttattgtctataaattcaatcttccaattaaagtatccactctcctcatttttctcatatttgaaatatgccgaaaatgtattaccttttttactcttaagatttctaaatcctacttttccattcttaagcagaagttcaaccatttctttagatattttcttaccgaaagatgctatatatctatcatctttccaaatcgtatatttgcatccatttttccagttactgcatccaaaactcttttcaccttcaattactggatttccacagactggacatggtcctatattctcactatctttaggtatttctactttaaatcttgataatgcagcatcatctttttttatcaattctacggattggattgtgaaatctgttataagtttaataaattcacttttagcaaactttcctttctctatatctgaaagagttttctctaatctacctgtatactccaagtcaaataattctttcactggaaaagtctcaaccaaatttctcccaagctctgtacacataagatttttaccttttgtctttaggtatcctatatcctttaatttctttattgtttctgctctagtcgctggagttcctatgctaaacccacttaaaattgcctgcatcatttcttctgagtcttcatcttttccttcaataccttttccgcaagtctccattactctaagtaatgttttttcagtgtgatacttaggtggcttcttagtaacagaattcactttagaatctacaatatctacagtttcatctatttcaatttttggtagaattacatctttactttctattttctctactactttccatccctctacaagctttacttttcctttcgaaacaaaaattccattcatttctgaaacattagcttttaatgtaactttcgtttcttcaaattcagctataggcataaactgcattataaatctatttttaatagcatcatatactattttttcatcagacgataagcccgatggctttatatatgttggtgttatagcactatggctctcaaccttcgagctatcaaaaattctttttgatgtactaaatttaatatctttttcatatggcaatccagcttttaatgtatttaaaacttttttcgctctatcctttaaactttcttctaaaaccacacttgccgttcttggataggtagtaagcttcttttcataaagagactgtgcaactttaagaactttatctgatgtccatcccttatatttactagttatatgtccttgcagattagataaattaaataagtatggtggatattctttttttaattctgtctgcttatcaataatcttagcagttgctccttcaagccttgaaataaatttatccaaatcttcctttttctcaaacttttcagaatcattctcataataaagtccctcaaattcttcattggctgaagttttgaagtttgacactagcttataataagttgttgctgtaaaattctctatttctttatctctatcataaataatctttaaagttggaagaagcactcttcctatattaatagtcttgttttcttcaaatttatatttcagtgtacttacagaagttaaattaatcccaattatccagtcactccactgtcttcctattccagcatcttgcagtggctgcatttccttattatcttttagtgattccattccgcttttaacttcatcaggtgtccactcgtttaaaagtaatctatatataggctttttcaccttaaaatagccaaacaattcatcagctataacctgcccttcccgatcgaagtcagtagctgatacaatgccatcaacatcttctttatcaattaaggattttattattccaagctgtttctttgcacccttatcttcaacagttctgtctacactatcacatttaaccttatataaaaaatgctctggaatgaaaggaaatttctcaaacctccatcccttcatattttcatcatagtcttttgcatcatataattgtaaaagatgaccaaacgcccacgttatgtaatagccatttccttcaaaataaccatctcttctagtttttacattaaatgcatctgcaatatttttagcaacagatggtttttccgcaataataacttttgccatgatatattttattatcctcctttaagcacaattaaaaaaataatggaccatcatatctgcatgttctgcactttaggtctattatttcctttcaggtgccttagttattacttgtagcacttatatatattaacactaatcaaaaaataaaaccagctgaagttctttatgtaaatatcaggtatcaaaaatagacaaatactctcatattaattatttcctttacatattaaaagaaggtataaatgaacaaatcatttataccttgcatctaaattattcaagcttttctcactaataatattttaacttattcttttctttcaatacacaatgctttatctgtttctttaagcatgttttctataacttccattgaagaatatcctaatttattattaaatatttctgtaccgcatactaaaaactcgcttcccaatttaatggctgactttatagtttcagtagtaattccaccttgcatctgcactgttccatcaaagtttctagtaaaataattaatgtaatctgctatttctttcgaattcaacatcccaaatgaattacttgaacgtgcacctgtagcctccacttgaaatgttaacattccaatcttatcttgaaatggcaatataaattccagtatttctttcttagtttttggaataaatctatccgttccgacaacctcaatcacagggcttacgcaagctcccatttcaattatctcatctataatttcctttaattcctggcgatctttcactacttctagctgaaaacatacagccccaacatttatgtgcttaatatcttttatatgaatcttaggataatccgtaagtaaatgtacattcaaaaatacctcatataatccagctatcgtatttaatctttcaagaaagcttatgttaaaaatgtgagaattaaggcttggaccatcacttccaaaattgctataatcatcgaagtttatatccacatgtaatgtttttatattaccttgttttagcaaaatttctacttcttcaatcaccttaccttgaattgtatcaatatcaagtgattcatctaatttatccagtatagtaattaatgcagggtttatttttataactttcccatttataacatcttttttgttataaaatcttaatgccgatgtcccataaaaaatttccctattattcttcattaaagcctcccgctaatttaagcttttattagtttattcttataatttatccaaaacttataatctttaaatatctactctatttcttttttctcctctattatacgcacttatattttctaataaatctgaaaacaacctacttctagcttcttcacttgcccacgctacatggggtgtcaaaatcagcctatctttattttttacttttaatagtgagttttctactggaataggttcctctttaaatacatccaaagctgcaccacctattatctcctcatctaaagctctggccaaatcttcatccacaattataggacctcttccaacattaattaaaacagcatcctttttcattttagtaaaagcttcataatttaataatccttcagttttttcatttaaaggagcatgtattgaaataatatcacattgctttaacaaagactcaaactccactcttgcaaaatctgaatctgaattttttcctgaagttgaatagtatactactcttgtaccaaaagcttgagctattctagctactctttttccaatggctccaagtccaattattccccatattttaccacataaatctttatatggtgcttctaaatttgtgaacatatcatatcttgagtactctccagatttaacaaagttatcaaaataacttatattatcgtataaatgaagtaacatagcaaaagtatgttgagctacagtcgtagtcgaatatcctcttacattagttaccgcaatatttctttctttagcatattctatatctatattgttatatcctgtagccatttcgcatattaattccaattcgctcgcatcttttaaatcttccctgtttaacttaactttattagttaaaacaatattagcatttctaattcttcctgcaacttcttcttcagatgtcaaatcataataaatcacctggccaaactcatttaatttaatatagtctacatttcctaaagttcttccatccaatactactattttcttcatactcaatctccttttccaactttaaaataatcctatttactctataatgataaaaaaagaagttcctaaaaattatgatttcacttgctaactttatgaatacacgccttatttttctatattaataataccgtaaacaaatttaaatgtaaacttatacgtaattattttacacctcaaccaattccgtattcatgtgttaaaaattgattttaagtaattaaaaatgactataatacgtaaaaaaaataaagagttatggatataaaatttttctctctccataactcttaattattttatttttaaatcaataattatttaatatgggcaggttttatataccaaatctcatctgcatattgctttatagttctatcacttgaaaatgttcctgaactatatagattagcaaaacatttttgagcccatttctttttatccttataatcttcaaacactttttcttgagtctgcttaaatgaatcaaaatctgcaagtacataatattgatctctttcctctaacaaagcattatataaatcttcaaagtatccagttcttccatcatctagtgtaccatcgattaaggtatcaactactctcttaatacttggattttctctataataccattttggatcatagtcatgcttaattctttcaatatcctctactctaagtccaaatatatagttattttcctctccactttcttgaacaatttctatgttagcaccatcataagttccaaatgttggagtagcattcaacataaatttcatattgcctgtccctgaagcttctttcccagccgttgaaatttgtttagataaatctgaacctggaaatagtttttgagcataagacactctatagttatggacaaaaacaacttttattttcttagaaacttctgagtcattatctataagtctagctatttcatttataaactttacaatccccttagctcttctatatcctgggaatgctttagctccaaatataaatgttgttttgggtatatctaaatttggattttcttttattctgtaatataaatctaaaatgtataaagcatttaataactgcctcttatattcatgtaatctcttaatctgaatatcaaagaatgaatctggatctatattaattccctcttcttgtttaatatagtctgctaattgaattttcttctcatgcttaatttccataagtctctcaagcactgcatcatcatctttaaatttctccagtcccttaagaagacctaaatttttaatccactcttcacttcctaacaaatctgtaataagctcggataattctgcattgcagagcctaagccatcttcttggtgtaattccattagttttgttttgaaatttatttggatataaatgataccagtgatttaattcattcttctttaaaatttctgtatgaagtgctgcaacaccatttacagctctcccaacaaatatagctaaattggccattctcatctgattatttgcgacaattctgaaattccatattgcaccttcgtcatatcccttttgtcttaactcattcattaatgcttcatcaacttgatatgcaatttgaagtattcttgggaataatctttctattaatcttatatcccacttttctagtgcctcagcaagtattgtatggtttgtatatccaaaaaactctttagctattgataatgcttctgaaaattctacatactcttcatcaactaatattcttataaattcaagaattgatattgttggatgagtatcatttaattgtgccacattgtattttacaaattcagaaaaatctgctccaaatttagccttatgtttttttagtatatctttcatagacgcacttgagaagaaatattgttgcctaagccttaatatctttcctgcctctgctgtatcatttggatataatactcttgatatatcctctgctttatttcttgctgatacagcttcaatatattgttggttattgaatagattgaagtcaaattctcttaaagcctcacattgccataatcttaaagtatttatatttttagttccataaccaattataggtacatcataaggaactgcttttactgtcatatctgaatatctaattatttgaatttcatcatcttttctaacactccatgaatccccatactttaaccatgtatcttcacattcagtttgaaacccattttcaatgttttgtttaaataacccattgctatatcttattccatatccaactaagggcatgtttaatgtcgctgcagattccacaaaacatgctgcaagtcttccaagcccaccattaccaagtcctgcatcttcttctatttcttcgattctatttaagtctatatttaactcttttaaaacatacttaacttcatcgtataaacctaaattcattaaattattacctagagctcttcccattaaatattctgctgatagataatatgccattcttcctttattataagtttcacttgtttcattccaattatcaattatctcctccaaaatagttaatgaaagcgcattaaaaatttcataatcctgagcatccttcaactttactgcatgttttacttttaaatatctttctataccatctcttattctttgtttatccacacttactcacaccttccataaattctagttaatctatatattttatttgctaactcattagtaaaaacaccgtcttttgctctccatgtccaattttctccaatagtagacggtaaatttattctagtttcatttccaagatttaagaagtcttgcataagtgcaatagatgtatctgcaacactgctccatattcctcttataaatccccaattatacccttctttttctgtaagatttaaatattcaactgcattctcaacttcattcttacttcctgtcgtttgaatccaaccttttatagtatcattatcatgagtcccagtatatgccacgcaatttctttcataattatgcggtagatatggattttcacaatcacctgaaaaggcaaatgctaatactttcatacctggaaaaccagtctctattttaaattttatagtatcttcagttaatagacctagatcctcagctataatctctatatctccaagttcttttcttattgcattaaataatttcatttctggtccttttacccattctccatttacagctgttctctctccataaggtatggaccagtatgcctcaaagcctctgaaatgatctattcttattacatcataaagctttaagctctgcctgattctatttatccaccatttatagttttccccttccaaatactcccaattataaataggatttccccaaagctgcccagttgaagaaaatgcgtcaggtgggcagcctgaaatttttattggagttaacgtttcttcatctactaaaaatacttttggattactccacaaatctgcgctatcctctgcaacatatatgggtatatcacctataattttaattcccaattcattaacataatttttcaagtttgtccattgtttaaaaaattcgtattggacaaatttccagtattgaatttcatctttaagttcttctttatagttctttaaaacatcatttttccttaatttaatatcagcatcccatgtttgaaaactttttaggtcaaacttattctttaaggccataaatgtagcatagtcatcaagccacatatcttcttctttttcaaaattcttaaaatcctcagattgtttctgcttaaaattttcatatgccaattttaatactttcaatttttctttaaataacaattcataatttatacgctctggattatcaccaaaatttatttcatcataatcggactttcttatcaaattttcagactctaaaatatcaaaatcaataaaataaggatttccagcaaatgccgaaaatgactggtatggtgaatccccataactagtctgtcctaagggaagtatctgccaaaaactttgacccgctttcttcaaaaaatccgcaaattcatatgcctcttttccaaatgttccaattccatatctacctggcaaagatgcaatatgcataatgattccactacctcttttcattctcattcctccaccctctaggaatatatataataacttaaagtattatatatattattttcctttttaatattctttagatatcaataaccattactttaacaaattgaagcatgaatccctctcaattaaattagtttctaataatatatgttggttttcttttctttcattaatctgagatattaataaatttatactcatagttgccattagcttgtccggctgttttactgttgttatactaggattataatattcactttcatccatgccatcaaatccgattattgatatatcctcaggaacttttaacccactatcaagaattgctttagcagcacctatagccataatatctgaaagagcaaaaaatgcagtgatatcatttcttctttttaataattccagtgtttcattatatgcgcctctgcttgaatatccaccaacaataattaactcatcatcaatttttattttacttttttctaatgcttccctatatccttgcattcttaatatgcttacgcctatatcatcagcttctcctaaaattaatgctatttttttatgacctttttctatcagatatgaggttgcatcatatgaacttttaacattatctataccaaccgatgaataatattccttgccttgttttgaaacagtattgacagaagttagtactatagggacatttatttctttaaaacagtcatctgtaatatcagcaaaattaccgcctaagcagataattccttgtaatttcttctcttttataaaagctattaaagtttcaacctcttggtcattcttataatcattttgatgcaatatcattgtatatccattttcatttattatatttcctatgacattaatcatttgagaaaaaaatggattgaatacgccttttactaaaactcctatattttttgtgttttgttgttttagtattctagcactattattaggtatataattgctttcttttattacttccaaaatcttttgtcttgtactttctttaacatcaggatgattatttaatactcttgaaacagtgctgactccaacctgtgctaattttgctatatcctttatattcatatttatctcctgcatcactactaaattataatagttcggtatcgttaccttaatttcccgttaattcaaaaatctttattaaatagatatttaagcatacaatattatattcgttttattcgtaatcatgtttatataacaattcagttatttaattaactttaataacattttaacaaacgcggaatatttatacaataaattcctgaaattatattatattttcttaattttctatttatgattacataatggctgtcttattaagtatttttttgtaattacgatacttataaaccaacaatttttttatttattcttacttgtttatatttatatgactaaaaataaaaaatcttatctgaagattacttttaacgatcttcagataagatttctagctatatctattaaattttattcttttgaatccaaataaagaaggctatcttgaataatgcagcatcattaaatttccttatatcgtaacctgtgtatttttgtatcttatctaatctataaattagagtatttcggtgaacatacaatccttttgaagcttcacttaaatttaagtccgatttaaagaaaacctctatagtttttaacatatcttcatctaacttcgaaaaactttcattaaagttatttagtattttttccttaatatcctgatttaaattatccataacttcttcaaataaaaggctgttacatccaaataccatttgagatacattatactttttagctaaattaattttatacatattttcattatataacttgttcaataattcataatccccaatatgacaataacttatataacacttttcgtaaagtgagaagtatattgtttcacttatactagatacatgctcctttatatcttcaaaaattccaattaaaatgattgtatcttcaaatataagaatggttacatcattattattataaacattttttaacgcctctaatgcctctgttactttttcttttaaatttaaagtaactaaaaatgtttcttcttttattggcggcataatttccttaatcttttccttagatatacttaagccttgtaataactcagaaactattttttcttttttgttataactatctttatacctatctttgatacaaaatactaatattcttatgaaatccttgcggtccccttctgtttttattttgaaacttttgggtccaataaaaaatgtatcttcaagtatattttcgctaaaagaattaggattagccttaaatataatttcatcgtccacataaacttcaaatggtatttcacaatcttcatatatttcttgtaaatatttcactaatcccttcattccctcacctcaattgtcactaatttaatactagcaaattctcaactctgtttctttatcaaaaacatgaatattttcatgttctacatataatttaatcttgtctttaggttctgctttagtacttccatcaactcttgcagtcatattattatttcctgacttaaagtaaatgtaactttcagcacccatacgttcaacaacttctacatctccagttaaagttgctgcagggttattttcaattatttgagcattatcatctaaatgctcaggtcttataccaaatactacttccttattaacatatcctttttcttttaatactttagctttttcttctggcaataatatattattttcatcaaatttacaatataactttccttccttttcacttacaataccatttattaaattcatttgaggacttcctataaagcttgcaacaaataaattatttggcgtattgtatatgttaagaggagtatcaacttgttgtattacaccgtccttcattacaacaattctagttcccattgtcaaagcttcaacctgatcatgagtaacgtatataaatgttgttcctaaactttgataaagctttgatatttctgttctcatttgaactcttagttttgcatcaagatttgataaaggctcatccattaagaatacctttggttctctaacaatagcacgtcctaatgcaactctttgtctttgacctcctgataaagcctttggctttctgtctagcaaatgttcaatatctaatctctttgctgcttctctaactttcttatctatttcatctttaggtgcttttcttaacttcaaagcaaatgccatattatcatacactgtcatatgtggatataatgcatagttttggaaaaccattgctatatctctttcttttggttctacatcattaactaattttccacctatatataattcacctttagatatttcttcaagtcctgcaatcattcttaaagttgtagatttaccacaacctgatggccctacaaaaactataaattctttatcttcaatttctagattgaaatcttttactgcagttacatccccttcataaattttataaatatgtcttagtgacaaatctgccatatttatttcctcccttttctgctttaattatctcaatttatattttatttaatgttttctgtatattcattttactatatgtaatcctttatattctatattgagaatttacaaaactctcttgtcttttttgtgaaataatataaaaggataataaaaaagcatatactaatcaaaactagatatatgctttgcttataatattttaatgtttatatacaacacttcgattaagcagtaagattatgttacaatcccttaaataaaagcttatttataatatccattaaatgatttaggatatttttctctatcccaagtataattattttcaattaaagtactatctccaactaaaaagtacttattcttatcacttgaatcattgttagtaacatctatatgataccaattaccttgaatttttacagcattccatgaatgagaaacatccttaattttcccgactacaattctattttctattcctgcatagttaaacattctataagcagtcattgcatacccctggcatacagctaatgaggttgtcaatgcagaataaacacttgtagattttagagtataatcatattcgtatctatttataatatactcatttatagcctgtactttttctaactctgacatatccttattaattaaagaattagtaattctctttaattcattatctacataattttcctgttccttagttgtcagatattttacatctaaagttgtctctataccattttcagtcacctttgctttaggctttatctctagccaagatctctctaagtaatcatcttttgaatatgcatccttaatacaattacttatattctcttcaaattccgaccttgcccctgtatataaaatagtaaaatcagtatctctattttcgagatgattataaatatgattttccatactcttcatattattaacttcatcatacgcaaatgcagttacagttatagcttgtataataacaactgctatcattattgttttgaaaaactttttcataattaatatgttcccccatgtcatttcaacactttcaatttcatcatatgtagaccaaactcgcttgcgactctgacgcttgagattttttactaatctgcctttttaagcatatgtgagagaaatctgccacgcgaatatattttccttttgaacgtaaattttaaatcaatctttttcataatttatactcacaaaaggcacaatattagcagattgtctaataccatgactttctagagagtaacaaataagttatcattacttctattgtacttactttattcattttgtaaatataaattaatactttatttatattttgtttataaattgttgacttttccctatttttcttccatttatgcacaattgacaatctttatttatacatatatattataagttatatatatgctaagggaggtatacaaatcatgaacaaaccaattataggcataaattcaaacagagttattaaacacgaaactcaatattcgcactcagttgtagaatcacttggcaatgattatgttgaatctgtaattaaagcaggtggtgttccaattatacttcctattctttctgatgaagaatccattagaagacaagtcgaactacttgacggcatcgttctttctggtggaatagatataaatcctttattatataatgaagaaccatcgcctaaattgggttatatttaccctgataaagatgagtttgatctgacacttgtaaaaatagcttatgaacttaataaacctattttagcaatttgtagaggtcatcaaattctaaatgtagcttttggcggcacattatatcaagatttatctgatatgagtggttgttatataaaacatcatcaacaaacaaaagatggagcggctagccatactttagaaattattgagggctcaattttatatgagatcttgggaaatactgcgctaattaattcctttcatcatcaagcaattaaagatttagctcctggttttaaagttacggcttactctaaagataaagtgattgaggctattgagagttgtgagaaaaattttgttatcggtgtgcaatttcatcctgaaattatgactgcttataacgataaaaatatgcttaaactttttgaagcttttataaatgcttcatataaaaataattcattagatcataaaaaataatttaaaatccctaaattcaagttgccttatgcaattaaatctttgtatacttgcctttcataagatttactttagggattctaaattatctaaactataaaagaatgtgcctatattatactataaatatggagttgcaatttatcgcatattttgaaacattttcaacacattaagtattccatacccccatactggattggggtataaatctccacttctttgaactgcacctctttgaatatatgtttttattgtttgcgaatatatattagggtcatttccttctacaattccccattgaaataacatagcgcaggcccctgctaatatagccgctgatacacttgttccattaacaatagccgtttgattattaggcgctacagttaatgcatttatccctcctgcagccacatcaattctattaagatagtcctctaaaaatgctattccggaataatctagaacattattatttagctgattatacgctgctgcagtaattgtgtattcagaacacgctggattacttatagttccatatggatctgaagaaataaacctagttcctccaatactaactccttcttgaggtatccatgcattaaatctgccatttagaattgactgtcctgtcagggtaaaacgccaaattccttctgttatatttaataaccttactctcattaattgatcacctgtgtattcttctggaacatagtaatttactaccattgaagtggtttcaaatacgaatgaataagtttctatagccgttatctctgcatttatagttccagtactctctcctgatggtgatattatatttaatgtcattatattaggtgattcaatccagatatcaactattatattcttttgctctggcgatatatatagctgtattgttctcgattcattaacttgagatattgtacctgatgtatgtgttccacttgcaccttggtttcctgagccattaactattgcaatcccactactttgagacataaaatccatatattgttctaaaaacccatttcctttatgacctcctaaattactttctaatggcatatatataaccataggcttattattttctagtgagtatctatttaaaaattctagtgctgaaaaaagagataacatgctgtatataggtatttgtatattataccgtcttttataagcaatattttcaagaagctttatcaccacaaaatcgcattctggaaccatcccctttaaattaggattttttccaactgatccaattatccctgccatatttgttccatgacctatttcatctttggttggaactatatcgtaaggcgattgtccagacctaaaagcatctattgcttgttgtattgtacctttgttgtatacacttccaaacggaactccattctttccagtttgctgctcagaagttatagtttgatcccaaatgtactctattttagtctgcccattttctcttataaattcatcatttaaataatcaatacctgaatctataattgctacatttactcctctccctgtaagtcttaatggcagctctaattgcaaaaaattagcttgggatgcttcgattggcgaaacttcttctagagtaaatatatctggaaaggccctatatattactgtagaaaaaaccggaatcggtgtacctgtatcaagctctacaggtgcagataatatagcatattgattatcaattatagtcgcataataccccggctgttttgaaacttcatcctcaatgttaccttcgtattgaactatataatgataataatttgcatcagaaaaaatatttattggtgctctaaaaccttccttcatctaaactttacatctcctgcccttggaattcttataaataatttatttacataatactcttcaaactcacggtcttcatttgtatattttttatcagtaatattcatcctagatctctggttgttatttctatataaaccactgattatattgaaaatacctagtagatcaaaatcaccataccctgtttctctgctgggatatctattagctgaatttctgttggcaccatacattatgtatgttctaatttttttagtatacatagtaggatcattatgatctacaatcccccattgtaataaaagcgcacacgccccagtcactaccgctgtagcagctgagctgcctgaaaatgttgttactcctcctccaacttttgttgttaatatatttacacctatagttgaaatatctgggttaatcaatccattagtattaaatcctttaccagaagccgcaattaatgcattattatttccataataagatactgtgataacattgacagctgttgatggtattgtcagagtggtaaatggatctgattcgagaaatattgtattttctggcagagtacttttgggaggcagccatatgtcatatctaccatttgttatatattcccctattaaattaaatgtccatgtccctggctttatattactaaatgtaagacttattacttgatgtcctgtgaagtgttctggtgaatagaatcttactagcatatctgtatttaaaaaaacaaatctgactggttgaactttatttattttagattgtataactgctgaagcctcacctgtcggagaaattacatttattgatgcaatattaggtcttcgtatccatatataaattggaagaaattttatttcccttggtattctcagttctattacttttgtatctcctacattcctcatatatcctgatacatgcccttgagaatcccctcatttccaactccatttactacgcacaatcctctactatttccaatggatgttatatatcttgaaatcaagttgttaccatcatggctaccttctgtgcttccaacacctagatagataaccattggttgcttacgttctactgcgactcttctcaaatattctactccagctacaatttcagatgcattatataccggagtataaggaattccattttcttgcaattgtcttttaaaattagtagattccaaaagcttaacaataacaaaatcacttgcattagcaattccttgaaactcagtattatatcctcttgctcctataatcccagcaacttttgttccatgtccaacttcatctctggaaggaactatttgatacggatctccattatttcttttagctgcaatagcactattaatttgatcatttgaataaatttgtcctatatatacagagtcactagtattactttgaacagattgatcccatatacttattattcttgatgtatcatcttctcttataaactcatcatttaaataatctatacctgtatcgactattcctattagcactcccatcccattcaaatctaaaaagggatttatctttatgttatttatattatctacagatgatggtgagatatcttgtaatacataaattgtcctaaaatcataaaatacaattgctggaacatcatttaggagcctatcaaaatcattacttcgtacagatattactccgatattgcctgtaattatatccccacaagcataagataacttatctatttgttctttgaaattccctctatactcaatcaaataatttgccgaatcgggatcataatataaattacagtcacgtaaatcagacatatctaactcctaatattacttgcattaatattatatatatttttatattgtttatttgatgattgaaattatttgttcatctctaaattaataactgtgatattccttaatatttaaattaaatttttcatcctcttataatttctaataaagtaatcaaaaaaagcaacaaacattataatgcttattgcttaaaatacttttaattatatattattctgaaaacttagtccaaacctttatattcaaaccagtcaacatcattaactatcttcatgtaaattaacaaaaaaaatagccgtcggaagaatatcggaagaaattaaccttccattctctcaactgcctattttacatatgcgagataagccataagccgagttctgtattaagcaatcatctatctaggcctactgttgccagtaagctcaagcgacgcacccggaggcgggacgggcagccccttaattgcctccctattcggtcttgctccaagtggggtttacatagccgtgaagtctccatcacgctggtgagctcttaccatcacctttccacccttacctaagtaaacttaggcggtatatctctgttgcactttccttcaagtcgccttgactggacgttatccagcaccctgccctatggagctcggactttcctctcctagatctaagtctagcagcgattgcacgtctcactcgcaaaatctatattaacatatatctttttaagatgcaaatatattttttatacaacatttctaaattatagttatattaaaaaaaatattattgttaataatagtattactattattccatataaacttacgccacagaatagaagcgttaataatataagtccaccaacaattaatttaggataaagtaaaaataaaagaggattcttgctaggaaaaaatggtggaaatctaccattccatccaccatatttacttcttctgcttcctcccctaaaaaaatttcgtattgttttcttactatgtttaaagaaatttttcaagtcatcttttaaatcttcactatttttattattaaaatcatgatctttccccataattcaccgcacaattattattacactattagtatatgcacctattcatttttttagtaaactctttttcaattaattatatgcattagaacttaacatttaaataatttagtgcagttatgaccttaatataaagttttactaaatattaatttattaaacaaactcataaggatcttcacttttttttgaagcaatgaactctacatctttaaatttttcccttaaaaaatccaatgtttttaaaaacacaaggtactctgttgagaaatgtcctgcatctattatgcttatacctaattctttgaaatccgatgcaaaatgatatgttgtgtcccctgttattatacagtctgcaccaagatcttttgctttataaaagaaatcttgtccactgccattaattatagctattgtccttgctttattttttcccctaacaatcctcatattttttatatttaaattttttttaataatttctataagatcattcaacattatttcttcgtctaatttaactagtcttccaattccgccatctttataattattagattcattaggttcaataatttcttgtgactcaaatcctagcattctaactatagtttcgttaattccgcctttagcactatctaaattggtatggcaagagtataaagctatatcttctttaattagatttatcaacttgttccccaataaatctcctttaactatactcttaggtcttttgaatagcagtgggtgatgagttattattaactcacatcttaaatccgctgcctcctcaatcacttcatttgtgcaatctaaagataataaaaccttgtttatagtcttatcttcatctccaaccattaggccaacattatcatacgattccattaaaaattttggtgcaaatttttctatttcttttcctatatcctttactttgaccataatctcaccgcctaaaaactttttagtagcttctttaacttctcatttttttctattaattcatttcttctcgaaattgcatgttcagtattatctttaataaaatctattaccttttcatttttttcaattttactttctatgtatgatttaaatagtggtgattttttatttaatataaatggacttatttcataaaatatattctctaactttatataatcacctctcttatacttaactttaaatatctcataatacttgtcttcatccaagcaaatgtcctcttctaatatttcataatcgctagtatataaatattctcttaatacttctggattttgtgctggttgaagcaataaataatctaattttttcaccttatctaaatcattctctaatatatctctaattaaattgccacccattcctgcaattattacagcttgagcttctttattttttaatacagctagaccacttcctaatcttaaatctaccttatctaatacgccatcaagcgctgcattaattttagcttttttcagtggatccttattaatatctgatgcaataacttttttagctatattatgtttaactaaatatattggtatatatccatggtctgttccaacatccattattatttctactttattaattttttctataatccattttagtcttttacttaattccatatttacctcttttttgtcttacttataaattttagatatccaatttaaggattcgacttattagatgaatgtatttacaaagttgctaaaaccttaagttcatatcttcactagaaatcataaatatatttatgatttcggtatgttattacacaagtctaattttaaagtttgatatctattaattccttatttaaaaagaagcacctaattttaggtgcttttagctactaatctagataatcttttaatttcttgcttcttgacggatgtcttaattttcttaaagcttttgcttcaatttgcctaattctttctctagtaacattgaactcttttcccacttcttcaagtgttctggctcttccgtcatcaagtccaaatcttaatcttaatactttttcttctctaggagttaatgtatctaggacattgattaattgttccttaagcattgtaaatgctgctgcttcagctggtgctggtgcttcatcatctgggataaagtctcctaaatgagagtcttcctcttcacctattggagtttctaacgaaactggttcttgtgcaattttttgaatttcgcgaaccttatctactggaagttccataaccttcgagatttcttctggaaatggatctctacctaattcttggagcaattgtctttgtactctaataagcttatttatagtttctaccatatgaacaggtattcttattgttctagcttgatctgctattgctcttgttattgcttgcctaatccaccatgtagcataagtcgaaaatttatatccttttctgtaatcaaatttttcaacagctttaataagacctaaatttccttcttgaattaaatccaagaataacatacctcttccaacatatcttttagctatacttacaactaatcttaaattcgcttcagctaattttttcttagccttttggtttccttcttcaatttctttcgcataagttatttcctgttcagaagacaataaaggcacttttccaatttcttttaaatacattcgaactggatcatctatagctataccttctgggaccgataaatcaatttcttcttcagtttctgtatcagcaatttcacctattatttcaacacctgtcatttccaaaacttcatatatcttttctatttgctctgggctcaaatcaatatgatccatagcttccataatttctttatatgttagtgaaccattctttttacccttgtcaattaattcctttacagccgccattttagcatttttatcttttttatcgtcttttggctttgttacttttccattagctttttgttccatcttattattgcctccttccgtcataaccttcaacctctctctccctttttaagtgcttcagataatttagtaagctctattgcaatttttatagattcttcaattttcccctctttttcgaacctattttgctttttctttaaatcctcaatttgcagtttaagtttaaagcctcttacctcttttaaataatcttttattagtcgctctctatcagtaaaatctaaaatctcatgttcccttatcttggtcaactctttagaactttctatatcgtcacatctactttctacataggattctatattacctatatcattagtatcctcacttttgccttgtaatattaatgaataaattttattatgtgattctattacaaaatctcctgattttatggagcttttaatctcatcataaaattcatctttgaacattaattttaataatgctctttcagcctttaagtatgcgggttctacatataattttgttccaaaatattcctttttattcacaaaattgtcttctttttgtttttttgttattacttgtgaaagtaagtcatataatgcctgttctttaattgctgtttcttctgaaattttccttatatatacatctttttctataggatttagatctgctagaatttctgcaaatttttctccatattctactaaatcatttccactatttagatttataccttcagctgctttcttaattctatattcaattaaaggaagcgcttcatttgccaacttcagaaatgactcctttccatgattcctcacaaactcatctggatcttttccatctggtactatcaatacttttacatcaaatccagcacctcttagaatttctagacctcttaaggtagcagtctgtccagccaaatcagcatcataagaaattattaccttattaacataccttttaagaagccttgcttggtttactgtaagtgcagttccaagtgatgctacaacatttgttataccagattggtgaagcgatattaaatccatatatccttcaactataataatgtaatcctcttttagcttattcttaattgcaaaatttaatccataaagatttatccctttttgaaaaatcatggtctctggtgaatttaaatattttggttttgaatcatctaaaaccctacctccaaatccaataacttttcctcttacatcaaacacgggaaacattactctatttctaaatttatcataaacattccctgatttctcactttttgagatcaatccagcttcaagtaatagattatctttatatccttttgttcttaagtagtttgttaatccatgccagctatcttgagagtagcctaaaccaaatctctttatagtttcttcttttatccctctctttaaaaaatattcttttgccattttaattctttgtaaattagcaaaataatatctagctgtttcaacatttactttatataaaaattctttctttctagaaactgcgctattttcattatcatttatctgtagcggaatattagctttatctgctagatattttgcagcttctataaaagtgagttttttatatttcataacaaacgtaagcacatttcctgcttctccacatgaaaaacatttgtatatctgtttttcacttgaaacactaaatgatggagatttatcattatggaatggacataatcccataaaatttctacctgatttttttagccttacatcctctgaaataatatcaacaatgtcattttgttcttttatcctttcaagaacttcttctgatatttgcaaggagacatctccttcctactgctttttttggcaattatatattattcgacataataacgagttttccttctaaaataattagaaaactattaatttttttttaatttaaagtttcaccagttataaaataatatttattgaataatactatatattaaagtaattctttttattaatttaaaatcctcttttttttattgcaaatctttattcattgagaatattattaaattcattatagttttaaactttctaagacatgaatctcatatataattaatctattacaaacttagggataaatattttattaaatagtgataagcaataatcatcactcattcccgccacataatcagcaactcctcgtttcaggccctcgtttttagctatgctcacataaatatctggcatctcataaggattttcctcaaaatgtttaattaattgatttaaaacaaatttcgccttatttctttcaacctttaatgtatcccctaaatatatatttttaaacataaattgtctaagttcagtcattgcttcacttatttctggacttaacccaatttcctttaccccattattaagattatcatttgatttttttataaaatctttaattaagacatttaatctttcgtttgaagtatctccaaatactttaacaatttctcttggaatctcttcttttcttaataaacctgctcttatagaatcatcaatgtcatgattcaagtacgccattttatcgctaaatttcaccactattccttctaatgtaattatatctttaacgcttccaagcccactatgatttaatattccattaattacttcttcagttagattaagcccctgcccgttattttcgagtttagtaacaactctaacgctttgttcattgtgacggaatccatcttctaaatattcatttagcacttcttctccattgtgtgcaaaagcaacatgcccaagatcatgccctaacgctatagcttcaattaaattttcatttaatccgattccagctccaatatttcttgcaacttgagatacctctaatgtatgagttaatctagtcctataatgatctccaaatgtttttatatatacttgtgttttatgcttgaggcgtctgaatgatttgctttgaataattctatctctatcaagcatataacaagttctaatatcatcatcttcttctctaatttttctgccaatagaattttttgaaaaagcagcttctttaattaatgtcaagctttcaaaattttgaattttttctcttacattcatatattatcacctctttttatgtattctatctatatcattatattcctctatttattaactatatttattatttgcaaataactaaaaaataatatctttatattcattaatttttattttttattatttttagtctaatactaagattaaattaatattatttaataattaggaatttttttatatagaaatcttacctatatatatatttctatatcttaattaaaatttaaaaacatgttaattttacttaaaggtataactttcaatcaaagtttaccttgtatcataaaagttcaataaaaatcaccttataaaggagcgtatttatgggtactgaagttttatctttacaagaatctaatctttccccagaaattataaaacaaaatgttttaccatactataatttacaaaactctcagatttcaataattaaatttaaagatactgataagcaaagagcagtttatagggtaaattataaagataaaaattactgtctaaaaaaagtttattataatttgaatgacttgctatatgtatattcagctattgagtggctatatagaaataatattagggtctcaaaacttttacctacaattgataataatagatttgtatcttatcgagatatgctttttatattaactccttggattgagggtgagaaatgtaatttcgataatttggatcatgttttaatctctgtaagaaaactctctgagattcattcagtatctcgtaaatttagacctattttaggaagttcagcaaaagaaggatttgaggattattacatatctaccttaaaacattttgaagatttacttaaagcatcaaatgaatcgtttaaatacaaagattcattttcaagacaatttatttcaagttttgatataaatttacgccttgctaaactctctctagacatatcaaataaaattgacaataatgaattaagtaaatctttatgccatggtgactatgtaaacaaaaacctaatttttcctcctgatctagatccttgggtgatagattttgataagtgcaaagtagattacagtgcaaaagatctagcatattttatgcgaagattacttaaacgagaaaacacaaaatggaatgttgagttagctctctctatattagatgcctataatgaattgtgtcctttaacacactcagatttacgttacttaatttcttatatttgctttccgcaaaaatattggaggatatcaagagactactataggaatattcacaagtgtaataaatctgctttcttaactttaataataaacgcgacatcaaaaacaaatcttcaatatgattttgcgctagatataataaatcaagtacaaaaaaaattcaatatgactttactttgaaattgtttctgtaaaccaccatcttttattaggttgagccaatcttctcttcatgattttataaaaactaactgcatcaggctgtctatattgtaaaatattaggcagcctgcattctaaataatttcataataacagcttaaaagtacgataataaaagagcattgtaattaaaatcacatgtgatttcaaattacaatgctctatattttttcactttaaatcttcttttactaagatttatatgctactttatcataatctttaattttttaaagttatcttggattttttacttgcgcttgtgctgctgcaagtcttgctagtggaactctaaatggtgaacaagatacatagttaagtcctatattatggcagaattcaattgatgaaggatctccaccatgctctccacagattcctaaatggatatctgaacgagtagattttcctttttctactgctattttaattagagaaccaactcctgtttgatctaatttaccaaatggatcttgttcataaatcttcttttcataataagcagataagaacttagctgcatcatctcttgagaatccaaatgtcatttgagttaagtcatttgtaccaaatgagaagaattctgcttcttttgctatttcatcagctgttaatgctgctcttggaatttcaatcatagttccaaccttataatctaaagttactcctttttcttccataacagctttaactgttgatacaattacatctttaacatattttaattctttaatttctccaactaatggaatcattatttcaggtacaatatcgtagcctttagttgttttaacttctattgctgcctctataatagctcttgcttgcatttcagcaatttcagggtaagaaactgcaagacggcatcctctatgacccatcataggattaaactcatgtaattctgaaacagtagattttaattcctcataagttattcccatttctcttgctaattcttttatatctgaatccacagttggcaagaattcatgtagcggtggatctaataatcttattgtaactgcttttccttctaatgcttcataaattcctatgaaatctgatttttgcattggcaaaatcttatctaaagctacttttctttgttctaaatctttagatgtaatcatttgtcttacagccataattctatcttctgcaaagaacatatgctctgttctgcaaagacctatgccttctgctccaaactcaacagcttgttttgcatctcttggactatctgcattagctctaactttcaattttcttatttcatcagcccatcccatgaatgtcgcaaaatgtcctgaaatttctggtgtaactgtttttattttttctccatatacatttcctgaagtaccgtcaattgaaatgtagtcttcagatgtataaacttttccgttaacttctacagttctctttacttcatcaacttttatagttccacatccagctacacaacaagttcccattcctcttgcaacaaccgcagcatgagaagtcattccccctcttactgtaaggataccttgtgctgctatcattccctctatatcttctggtgaagtttcaagtcttacaagtacaacatcttctccaagtgctgctctatctttagcttcatcagcagcaaatgctatcttaccacatgcagctccaggagatgcaggtaatccttttgcaattggtgtagctttctttaaatcttcagtataaaaagcagggtgtaataatgtatctaattgttttggttcaacttttaaaattgcttcttccttgcttagcattccttcttctactaaatcaacagcaatctttaaagcagcttgagctgttctcttaccatttctagtttgtaagaaatataatttaccttcttctatagtaaactccatgtcttgcatatctttatagtgatcttctagtgtgttaacaattccttcaaattgtgcatatatttctggattttgttcttttaattttccaatttcaagtggagttctaataccagcaacaacatcttcaccttgtgcattcattagatattcaccatatatagcattgtcaccatttgcagggtttcttgagaatgcaactcctgttcctgatgtttctcccttattaccaaataccatttgttgcacatttacagctgtaccccattcacctggaatatcatttaatcttctatatactatagctcttggattatcccatgatctaaatacggctgtaattgcttcaattaattgagctttaggatcacttgggaattcctcacccttttcttttttgtagatttctttgaattcactaactaattcttttaaatcatctgctgttaaatctgtatcaaattcaacacctttcttctccttaagttcatcaatcttattttcgaataatctcttttctattcccataacaacatcagagaacatttgaatgaatcttctgtaagaatcatatgcaaatcttggattattggtcaattctgccattgcttctacagctatatcatttaatcctaagtttaagatagtatccatcatacccggcattgaaactcttgcaccagatcttactgaaactagtaaaggatttgtattatctccaaatttcttacctgtagattcttcaagctttgataaactttcatagatttgacctattatttcatcagaaatctttctaccatcttcataatatttattacaagattctgttgtaacaataaaaccatctggcactggaattcctagactagtcatttctgctaagttagcgccttttcctccaagtagatttttcattgaagcatttccttcactaaaaagatatacatacttatttgacatctcaatactccctcttttcttattatttctcactatatttactatcgatgcctatctaaagacttcgtagctaccctgttaattaattctcattttctccaattttaacaaataattttgttatgttagtcttagaaacctttccgattatcttcatctgatcttttccatcagacttttctattatttcaacaaccggaatactatcgatctcatgttcaataattttcttagccaaatcatatgcgttatcattcttattcgcacaaattatatttggcattcttgtcataattactccaacaggaactctatgtatatcagtccccctattgaaattttgagaaagtcttttctagagactgcacctgtaagcaccccattattttctataaataatgtccctacatcattcagaaataggtatacgattgcatcatataccatcgtatcttcactgacagtcacaggttttgacattatttcggatactttaattttgttaatgtttgaataaatcaatccattagaagtctttcctgtatatacatatcctaccttcggtctagcatccaaagttcctatcatagtcagtaccgccaaatcagccctgagcgcagctctagtaactccaattttttctgcaagagcttcactagttataggtgcattttcttttactaagcatactatttcttcttgcctaggtgataatttcaatcttatccctctttctgtaaatataagaaatatttagttcaaattcattaatttttactactctctaattatatcatgtaattattgtttgactagacttaattttcagaaaaatcaaataaattcgctaaatatttcttgtatattaattttatatcactgatatatctatttttctttatattactctcaatatcacttaattttctgaattttctttctcttcatcaaaattaactgtataagtatatacagtatctgaaccagtatatactttttgttttgaatcatcactatgtttacctatgtcattcttcatttcattaaccttagtcttaattttatcagcaaaatcagtagctttatttttaacattgcttgccatttctgaaacatacgtgtttacaacttccacagatccatcttccatagttatctctattgtaatttgagtcgctattgccgcgataactcctgctgcaagtattggtggaattataatagctacaactcctgctgcaattcctgcattgaccggaatatctacaagctccttatcatctttcttgacctttatcctagttacatttcccttttctattatttgtttaatcaaagcctttagttcttctatagatataggagccctatttacttcctcatcaacaaattcatcattaatatctgataacttttgagacttttcaatgtatattaaagcctctaatacgtctccttcgcatacttctaaagcttcctttgccttttcatagcttactcctgttctttcacgtatcatatcaactttttctaatgttatattttccataaatcatcactccttaataaattttaacatctccaaacttttaggctttttagcatagctattagatactaaaaaagtaattactttttcaatctcactttttatttcattatttaaatttagtctatataatttatctatatccatattcatcaaaaaccttaaggcattatatgcaccttttgaaataaatactccatgttctttgggacattcatcacatatacctccatagtgggataaacttatataattagatgaagatatcttttttctacatacgctacaattattcaatgttagattatatccagttgtttttaataatcttaattcaaatgctcttattagtagttcgtaatctagggcatctgtattcagtaggtataatgttgtaatcaatgtcttaaaaagttccatattaatttcattatcagtacaagcaatatctattaattcgcataagtatgaggaatatgtaagtttatgtaaatcatttaaaagtccttgaaaagattgaattatttttccttcttgaagagtgtacaagctcttacctttatataccatatattctccataacataatggcaatgtcaatgctaagaacttacttttactttttttagcgcctctaactatagctgtaattttacctaacttctcagtataaaaccaaactagtttgtcattctctttaaaatcttgcgtttttataattacagcttttgtttcaactattgacaggtcaaccatctcccacttggaatatataaaaaaataatatgttaggctaattatctatttctaattgatactctatttctttgaattcgctttatatcctaattcttttaataaaagctgattatctctccattcttttctaactttcacccatatttttagattaaccttggatcttaaaaatctttctaattcatatcttgaattttcgcctattcttttaagtgtttgaccattctttccaattattattcctttatgggaatctttttcacaaattaaatctacttctatatgatatgtacctatttcattttgtttcatttgaattatatctactgctataccatgaggcacttcatctctcaaggttcttaaagctttttctctaattatttctgatactacaaacttttcttgaacatctgttatcatgtcgtctggataatatttaggtccttctggcattgctttcttcataagttctactaatacatcaacgtttttcccttttattgcagaaataggtactatctctgcaaatttaaattcttttgaatacatttctaaactttttgccactctatcttgtgtactttcatcaaccttatttaaaactaaaaatacaggacactttttatcccttaaggtttctaatataaatttatcgccctttccaatctcctcatctggatttgttaagaataatactaaatcaacatctttagtagattcttttgccgaatttaccatgtattctcctaacttatgtttaggtttatgtatacctggtgtatcaacaaatatcatttgataatcatcacctgtcaatattgtttgtatgttatttcttgttgtctgaggtttattagaaactattgataacttttcccccattatataatttaataaagtcgattttcctacattaggtcttccaactattgtaacaaatcctgatttaaacattttttcctcctcaaaataagcttaaaaaagcttaactaacgttatcctattttacaaatagtatactctatttataagtaaattgacaatctactattcttaatttgatcatataataatttaataattacttccaattgtttccttatgaattaaatcattaattcttataatttaagaaataggagacaatataagttttatttcatcttatatcttctcctataaatattatttttattattctatatttaattaaagcctaaataatgtaaaaataaacaaagttaataatataccaaatatagctccaactattacctctaaaatactatgaacttctgaatccactctactttgtgcagttataaacgccaataaaaaactcaatagaatgcaaattggttcctccgttattaatgatattgcagttgctattgaaaatcccaaagcactgtggccactgggcattcccccttttaacggagttccttctccaaatattgctttcgctattatagttactatacatactattactagaacaatcaatatcgtatatggctctgaattctttactttattaattaaagaaaatgaaaatctactgagcctatcccaaaatataatataaccaactaataatgcgtttatggctgttattaataccgcacctgccgccgcattcttagcgattttagccaaagggtggtaataattagttgtcatatctatagtcgcctctatggctgtatttataagttcagcagctattaccatagttattgtaacagctaatatcagaaactcatattttgttatgtcaaagaaaaagcttgcaattagtactactaacgccactattaaatggattttcatatttcgttcagttcttacagtatcgataatcccagttatggcattattgaagctttccagtgtttttttcattttcattatttacccctacttctattacataataaaaaatattaccctctgattatgttaagtttatttaaaatatcttcttctctacttctcataattattttatcatcatcctccatatgatcgtatcccaatagatgcaatactgaatgtacaactaagtatgaggcttccctttcatatgaatgattaaattctttactctgttctaatgctttttctaatgaaagaactatatccccaagtacaagttcgtcaccatcaaaatcagattgagaaaacttataatctttatacatatccttaaatactttcttatcttcgtattctaacataggaaaagataatacatctgtttctctatttattcctcttgtttcattattaatttcctttatttcattattatcaacgaacaataatgaaatttcacatttcatatttacttcctcttcttttaatgcaaattctattacttctgttaatctttctattaatttttcacttgcttccactttattttgtctattatctacataaatcattatttaaattactccttagttttaaattaacctttattgctttcaccattgaaatccttcattttttctttagggtattctattctttgatggtatatgctatttaacgaagtcaaaaaacatactcttattttttctatatcttttaatgttaaatcacaatcatttaattgtcctgatgataatttatcatctataatgcaattaaccatttggttaattgcatccttagtaggtttcttaattgatcttacagccgcttcaacactatcagatagcattactatcccagcttcttttgagcttggtattgggccttcatatctataatcttcttcttttatttcctctggattttcagcactatttttcatagtatagtaaaaatactttactaatgttttaccatgatgctctaatataatatcttggataaccttaggaagcttatattttttagctaactccagaccatctttaacatgagattttattatcatagcacttaaatttggaggtatattctcatgtggattatctatacccatttgattctctccaaagaaatatggcctctctgtttttccaatatcatgataatatgatcctatccttgtaattaccgaattagcaccaacttcttctgctgccatttctgagagatttgcaacaagcatactatggtgatatgttcctggagcttccattaataatttttttaacagtggtgtattaggatttgataattctagcagctttaatgtagtaacctcattaaatgtaccttctaaaaacggtaatattcctaatgcaaatatacctgataaaaggcctccaatgaatgtgattccaccttttactaacacatctccgaaattgctcgatattaatattccagtagacaatgtaagtattacggtaacaacagcagtatacaatgttgaatatagcaattcatttctttgttgcatctttttcaaaaatgccgctcctaataccgaacttactattcctagaataataatctgaacatcaaaaccatttaatgctcctataactattgcatttaaagcgctaagtacaaatgatatcttataatttagtaatagcgtaagcatcataggcgcgcacgcaaacggaattagaaaaggcgatataacccctacagttctagctaacacaagtgaaatcaaattaattgtacttataagaataagctttttattgttcttatatatttcaccataatttattctcacatatccatattgaagaaacaatattatcatccaaaatattgcaagcgctaaataaatatatacataagctgttacattttcatcgttaagcattccaagatctgatagaatatcaatttgatcttgtgttacaggctctccttctttaactataatctgattttgttttattattactttagatacattcttcttaacttcctgtatcttttcttgtgttttttcttcatcaaaaaaaacattggggtttatttgtgtttgagctatttgctttaaagcacttgatacatctttatccaagtttaaattatctatttgagttgaaacagctccttttgcttcttttaaggcaccttcatctttttcctgtatatttttttcatatgcactgtcaattatatttactattttgtcttctatgcccggcaaagtatcttttgatattcctatcaacgccttacattgttcatctgttaattgaaatatagttaatttcttaagctcagtttgcttatcagctacggtagagctcgccatattgcttaatgatacaagtttatcgaacaatgcccttacattatcctcagcttctttcttaacttctggctttgatgtatactgtttccctaccttttcggccgcttgatcttctttttcctttgtagctttttcatccactatatctcttggagcttttatatctactcttggtatatctccttcttttaagctatattgcttaggagttattgcggtaacaagcaataaatagcctatactaaatacaagtataaataatacaattctttgaattctattatttttccatttattattttgttttatatccatgtaattcaccttttcatcttaataataagtaataggcataaaaacaactttgaataccccttatgatacgtttttagcaatatcctgttctacagtaaatttaacattaattaagatctttccgccttcaatatcttctactgcagttttcttatctattatctttgcatcgttgctaagtgtttttctcaatgacccctctaacttttctgtagcttctttaactgtactttctttatctaagtttacatttataccttttttttcgaaatatgttatcttattaaagaaaccatccttctcttctattttatcataatattcaaattgatttatagcttttttcaagtaaacttttttcccaaaaaagtttaagtatatatcactattcttgttaccagttctctcaagcttttctccacttatttgaacctccataaatttatcataaaaagtatttgctataactgttccactcggttttacttccatctgaaagccttcccttccttggataggcaatattagatcgtcacctttctttactatatctcctggcacaactgctggatttcctgaattcgtatatactctctttacttctccatccattttagcaacaacttgattatataatgttttttctgtagacggaggatttactttttcctttataaccaattttaatgtagacccctctatcctaaccctaatccacattatctggctatttaaatcttccatctttttttctatttgatatacattaacttgtgatttgttaagccctggtttgattccaattgatgaaagctgttgtctaacttcaaatggacttaaattcctctgtgtctctatatctatagcccatatataatttgataatatatatatcacagcaaaaaataatcccattcctataactagagaaatctttcttctcattttcataagtaaaactattattccactagttcttactatcttaacttttcctttatatttttttattaatatttctgcatctttataatctctgtaatatatagttactcttaccgttgtcaagcttactttcactatattacaggtatagatttggctattccaaaaggcatttaatattttttctggcactaaagcattaatttctatggttacttgtcccgatttcaagctgctaaacataatattctacctctcatatgaaatacctttaaagattccgcttattgttatactcgtttctgcaataaaaagtatttcgaactctttcccctcaattatgattgcacctattctggaatttattttaaccatattagtttcgaaaaatataatgcccttatgattttcaatagttatttctctgtttcccacgactattatctttggtagatctaatgaaatgtcacttggaaaatctaacttgctaagtatcttttctttacctctttgaaatttttcttccatactttcctcccacataaactttctcattgtaatttatgataggatttgcgaattaattctataatttaataataatgataattttctgcaaaaaaataaagccaatcattactattatggctttatctaattcatttacgataatgtattctagttatatgaaccaaatattatcctttcattgctagtccaattttagataacaatgaaacaggacataggatactatttataatcctatgtcctgttatattagtataaaactcaaaacaatcttgaattttattcttatttattatttaaatattccttaacaagctgacttacaagtttaccatcagcttttcctactactttaggtttaacagctgacataacttttcccatatctttaatgctatttgcacccacttcttcagctgattcttttactaattgttttatctcttcttcacttaactgctgaggaaggtatttcaacaaaatttcaatctcagccttagactgatctattaaatcttgcctattccccttttcaaattcaagcatagcttctcttctttgcttgatttctttagctaatattgtaataacttcatcatcttcaagctttctattatcagttttttcaaccaataatactgcagctttagctgtactaattacactagatgtgaacttatcttttgcttttaaagcaattttccaatcatcttgcaatctatctttaattgatgacatttttgtaccttctttcaaaagaaaatatcattatttgaactttctctttctagcagcttctgatttcttctttttcttaacgcttggcttttcataatgttctctcttcctaacttcagaaagaaccccagctctagcacattttctcttaaatcttcttaacgcactttcaagtgtttcgttttctccaactttaatttctgacatttactatccctccctccgctagcttaaattaactcagctatgggcttaataacacatgctatattatacaatatttaaattaataatgtcaagaaattaagaaaaaatctccagttactattgatcaaataacaactcaaatttagcctggtggccactgtaaacttcgccctccaagtacatggaaatgaatatgttttactgtctgtcctgcatcctcaccacaattatttacaaccctatatcctttatctgatattccaagatctactactaatttaccaataactttaaatatatgtgatacaatatcaatattgctgtcatctaaagtattagcactttcgatatgttcttttggaataactaagaaatgagttggagcttcaggatttatgtcataaaaagcataaactttatcatcttcatatatttttttactagggatatccccacttataattttgcaaaatatacaaccttccataaattcacctccttctaagtagcaatctcaattcacaaacgtaagaatcgagattttataattcatatttagaaattctctttgaattatatatcttattccaaaaatgatccttaatcaatcttatcttgatttatattataccaaaactatataatttttccaacaacatattccgcatctgaggccattattttacataaaattatttttcctatcatatctctgcttccatttggaatttcaacttttacataatttcttgtatacccctcaaataccccaggcttattagatacttcttgctcaactaatacatctagttctcttccaactaaagatttactaaaatcgccttcattctttgcatttagttcaattaaagccttacttctcttgtcctttacatttccatctatttgattaggcatatctgaagccttcgtaccttttcttgggctgaatttgaatatatgtgttttagttaatttaattctctttaagtattcataagtttcgttaaattcctcatcagtttcacctgggaaacctacgattacatcagtagttattgatgcatctttaaggttttctcttattctattaactgcatcttcgtattctttagcagtatatcttctattcattctttttaaagttgcatcacagccgctttgaagtgataaatgaaattgtggacatagttttttcatttttttcattttctcgataacttcatctgtaaagaaactaggctctatagaacctatcctaactctttcaattccatccagtttctctatttcttctaataaagttattaaagttacatttccatctaaatcaacaccataagatgctgtatgtattcctgataatattatttctttaaatccatgttcacttaaattctttatttcatccaatactttttgagggtcttttgagcaagttgttcctctggtataaggtatgagacaatatgcacaaaatctattacaaccatcttgtatctttaaaaatgctcttgttttatcttgatactcttctatatttaattcttcaaactgtttattctttagaacttctccaaccattaactgaggtttttgctcatccttagccttattcacataataaacaatatcgcctttatttctagtcccaagtacaacatctaccccttgtattttagaaacttcttctggcgcaacttgcgaatagcatccaacagctgcaattattgcattttcatttcttcttctagctctgctaattatttgccttgattttttatcactcatattagttacagaacaagtatttataacataaacatcagcaaaaccttcaaagtcagttacttcataaccttctcttatgaacttttccgccatagcctctgtttcataatgatttaccctgcatccaagagttgcaaaagccacaagactcttcccctctgtattttttattggttctttgttagataacttcttaagcttagtcttgtcactacctgctctgactaatttcatttggttctctcccattatgatagctttcctcctaaatctcctaattcatattgaattaatgccgtagctgtaaatccagccgtctctgtacgtaatattctatttccaagagtcactatataagcaccctgttcttttaaatcatcaatttcagattcctcaaatccgccctcaggccctatcaatattccaacattatttatagtatctaaatccacactatctctttctaattttctcacaagagttttaatcccaaaatcttctgcattttcataaggtacaataatcaaatccatcttttttaattcatttattgcctcattgaaatctataacttctttaacttgaggaattacacttctttttgattgtttgcatgcctcaagagcaattctatttagtctatcaagctttttaaattcgcctttaagttttacatctactcttgcagttgttacaggaataaactcagatactccaagttctgttcccttttgtactatcaggtccattttctgaccttttggtagtccctgaaacagatgtactttaactttactttcattatttatatctaatcttttaataattttaactataacttcacttttagttatagtttctatctcacctagatactcaattccttcgcaattgtttaatactacttcttcaccttcagataatcttaaaaccttataaatatgttttacatcatctccaagtattttaccttcagtttcactaatattatgaggttctgtaaaaaacttatgcatacgactcctctctaattcacagttcacaatgctcaatgcacaattaaataataattgattacggtatatcaactatagattttctaaaaaatctcttagaaatttctcccaaactgtgcattgtgaattgtacattgtgcattattttcataattacattttcaaaccgttaaccaaaatttgcattacaaatatctatatttatactaattaattgctttagcaactatacagttccattctccatctttattgatttcaataacttcaaaaccacattcagcaaacttttctgtaaccatatctaccctatcatgaattatacctgaagttataaataatccaccttcatttagagcctttttaacatcctcagttagtacacaaataatttctgctattatatttgcaactactatatcggcttttccatcaactacatctaaaagatttccttctaatacttcaatattattcaaattattaaagcttatattttctttagaagaatcaacagcaacaggatctaggtcaaccccaacaacatgtttagctccaagcttcgctgctgctatcgcaagtattcctgatccacatcctacgtcaaatactgttgtatcaggctttacatacttatctaaagcttgaatacacatccttgtagtttcatgagttccagttccaaatgccattcctggatccaactctataattagttcttcatcatttttttcatattcttcccaaattggtttaacaacaatcttatctgttattttaactggtttataatattgcttccaattattagcccagtcctcttcgtgcatcttcttagcttctactgtaccttcaccaatatctattccaaattctttaatttcagaaagtttttccttaacatattcaacaatctcttcaaccttatcatcttgagaaaaataagctttaactacagctgcatttcctttatgttctaagatatttatatctgcaaaatcccaagttaatggtccttgatctcttgaaagtaaatcctccggatcttctattgcaacattagggcaatttaatccataaaatattcctgatataggctctaacgcctcgctctttgttattacactaacttcaatccatattccatccatgtttatcaacctttctaattcagtttcagtaacagtttgcaatttaggaatccatttttttcaaaatttattaaaaatatttttaaattccatagaatttttttcctacaattgctctttgctaactatataattttatttttttaaagttattgtaacccttacaataactataaatatttacatatttatatatttaacattgatatctatttatatagttaactatttacatagatttctatttaactacttacatatatatctagttaaatttatatattttaaaatatttttattgatatctagtttaatatttaaattttaaaatattaaacttcttaattgtgaccagtaagttccgtattgtgcttaaaagctcttaattgtgctttgcacttttttcatatatgaattgttcttaattgtgcttcacactttttcatatgtgaattgatcttaattgtgcttcgcactttttcataggtgcgtatcttttcatatgtttaaattcttaagtgagagtccaaaagtgatgcttcaaatcttgtatttggttagcagaactttctcttcgagcatcttgtatttggttcctcgaacttactcatcaaacacatgtgaatcgggtaaattcttaaattcttaaattcttaaattcttaaattcttaaattcttaaattctggtcattataaatctaattgtctttcatggcaatcaaaaattttatttttattccttgttcactaaacattttttcatgctcagtctgaacatttccttcaacatcactattgtgaagatcatatgttatatatttaattctaaaccctgcttcattaaaatattcaagcgattcctcaaataattcatcatcgtcagttttaaaataaatttcaccttcactctttaaaaatgttttatactgttcaagctgcctcatatgtgttaatcttctctttttatgcttttcctttggccacggattgcaaaaatttatgtatattctacttacaacatcttcttcacttaagatttcactgataagccctatctcttgagccattaattttacattatcagtcttcctatttttttcttcataagccttttcaatatttctttttgctaatcctaatacctcatcctttatgtcaattgcaatataatttatatctggattctcggaggcatgaactgccataaaagttcccttcccacatccaagttctagatatattggtttatcattaccgaaaaattctttccacttacctttatattctttcggatttataacaaaaaaatcgcaaccttcaagctcaggtcttgcccacggtttttttctcattctcatgttagttcactccatcttttataagcttttaaaaaatagcatttcactgcaattaagttttttagatcattaaattgaacttatcgacacaataccatataaacaagacgctcataccgtcttattgttctattaatcggccgtatccttcataataattatacctataaaaatttatattgcaatttttatctcaaaaatatacaggtattgcaaataactcaaatatctgtactgaatcttttatctcaaagtatttttatactttcttaatactaattaagaattctctcccccctcaagttgtttatctaaaaaatcatccaatttaatacttaacaccctatcattattaaatataaaaaaatagcacacctcatacttaagagaatgtactattttaactactttatcttatgacttattttttatatttctctattatttttaatagttcttcctcgttattttctacaaactcataaaaattcatatttttattctctatatataatgataattcatataaaaactctggtatttcactggcaagtaagtcaccataaacttttccgagccttgcacttcctgtttcaaatgatccgttaatatgtaattcaaatacatcttcaacaacatcgacaacttttttacgttttcctgtaagcccgataccaacgacttcatgaactgcacatgaatttccacatcctgatatatgaactcttggaagtatatctttattataacccttttctgcaaagtaattaattatattgttaagcattttttgactctctaaaattccaacttgacatattggcactccaatacatgatacactttgctgaagagctgtttctcctccaatattttgtgttaaatctaaaatttctttagcttcatcaccatttaagtttctaaaatataaaccttctgtcatagtaagtcttatttctaagtcttttactacttttaatttatctaaaatttctcttaatgtcttaacagaaatttgtccgccaattggatggaaatatacgctgtataatcctttttgcttttgtgaatataatcttgaatgttttaattcaatttctttaccttctttagtaatttccttagattctacaaataaatctaacgcattattatctaacacatattttaaatgttctttatatgtttctatgaatttctctttgcccattctctctaatatatatcttatacgagctttatttctatcttcatagttaccttcttttataaataaactagtcatggcttctacgtggtataatacatcacttggttttataagctcatcatattcgactgcaacttgaggatttcttccaattccgcctcccataaaaactctaaaatacttttcattatctttaattgttgctaagaaccctaaatcagctacattacaatgcccctgatctgagtcgctgcttgaaaaagatactttaaactttcttggaaatttatatgatgttattttgtttaaaaaatgtttatttacagttaatgcatatggtgtcacatcaaacgcttcatctttatctacacctgatagtggagacatagctacatttcttggaaagtttccgccgcctcctctagaatatatatcattatctataccatccttcattattccacaaacttgatctatcgttaaattatgatactgcactgcttctcttgtagttaaatgaaatttatctaaattatatttatcagctatatcacataaccaattcatgttctcaaagctactaattcctgaaggaattcttagtcttatcatgaattcttttttattacgttctgagtatacccccattcccccagaaacttttttaaaatccataatagatacttcaccagataaaaatttatttcctaattctctaaactcttctatttcaattaataatttttccttcaattccttcactttttctcctcctaaatataattattttaatatattataacctataatttaaaatatgactataactataggttttgtcggggaatttttatttaaaaaagaaactattgaaataatgctaattgatagacattattcaaatagtttctcagatataattctatttattttttccaaataattttttcttaggaacattagcttcatcaaactcttcaccagatgctctcataaaatcatataaagcttccttttgttccttatttaaggttttaggaatatcaacaataacttttacgtattgatctccttttccgtttgagttaactctttgtattcctttgccttttaatctaaacatagttcctgattgtgtacctggtggaacagtatatttaacatttccatcaactgtagctacagttatttctgtacctaatgctgctttaggcatagaaatatgagcatctatataaacatcgtttccttttcttgtaaacacctttgatggagtaacattaattcttacatacaaatctccaggacttccacctcttaacccatgttctccttgtcctcttaaaggcattacatttcctgtatctacacctgctggtatgttaacttttatctttcttgtttttctaacactgccttttcctctacactctgaacatggcttttcaataattttaccagtacctctacaagtatcacatgtagaagttgatacaaaacttccaagaggagtttgtctttgaactcttacttgacctgatccactacaagttgggcaagtcttagcattagttccaggttcggctccacttccatgacaatgttcacagttttcatttctagtaacagaaatttctttctctactccaaaaacagcttcttcgaaagttaatgttattgtatactcaatatcatttcctcttactggaccatttcttcttctagaatttgatcctccgcctccaaagaatgattcaaaaatatctccaaatccgcccatatcaaatccgtcaaagcctccaaagcctcctcctccgaatccgccactaccatcaaaagcagctgatccgaactgatcatatttagctttcttttctggatccgaaagtacttgataagcttcatttatttctttaaacttttcttctgcctcagcatttccttgatttctatccggatgatattttacagctaattttctaaaggctctttttatttcatcatcacttgcacccttttgaagaccaagcaattcataatagtctttatttgccattcgtttaaattcaccacctagttttatttactgtagaaaagggaagacgagcttgccttccctatcctattatattagataactgtagtttagtacacctaatttatatcttatttatcttcatctactttgaaatcagcatctactacattatcatcatgtggtgcactttgagctcctccagctgctgcatttggatcagctgctccttctgctccaccagcttgttgatacatctttgtagctattggatagaatgattgatttactgcttcgattgcagctttagtagcttctacatcatctccatctttaactttcttaagatcttcaattttagctcttactgctgccttttcatcctcagtagctttatctccaacttcatttaaagtcttttctatttgatatatagtttggtctgcgttatttacagcttcaactttttcttttctcttcttatcttcttcagcaaatttttctgcttcttttacagctttatctacttcatcatcacttaagttagttgaagcagtaattgtgatatttgcttctttaccagttcctttatctaatgcagatactttaacaataccgttagcatctatatcaaatgtaacttcgatttgaggaattcctcttggtgctggagctatacctgataatgtgaattgtccaagtgacttgttatccatagccatttgtctttcaccttgaactacattaatttcaactgatgtttggttatctgcagcagttgagaatacttgactcttctttgttggaatagttgtatttctttcgattaatggagtagctataccacctgctgtttcaattccaagtgttaatggagtaacatcaagtaataccacgtctttaacttcaccagttaatacacctgcttgaatagctgcaccaactgcaacacattcatctgggttaactcccttagatggttcttttcctgtaaagttcttaacagcttctactactgctggaattcttgttgatccaccaactaagattattttatctatatcatttaatgaaagtttagcatcagctaatgcctttctcataggttcaatacttctttcaactaggtcatgagtaatttcattaaacttagctctgcttaatgttaaatctatatgctttggacctgttgcatcagcagtgataaatggtaaatttatatttgtttgttgagatgctgataattcaattttagctttttcagaagcttcttttaatctttgaactgccattttatcttgcattaagtcaattccatttgaagctttaaactcatctgcaatatatttcattatcttctcatcaaaatcgtctccaccaagctttgtatcaccgttagttgataatacttcaaacactccatctccaagatctagaatagatacatcgaaagtaccaccacctaagtcataaactaggattttgtgagctgaatctgttttatctaaaccataagctaatgatgctgctgttggttcgttgattattcttaatacttcaaggcctgcaatcttacctgcatccttagttgcttgtctttggctatcattaaagtaagctggtacagtaataactgcttgagttactgtttcacctaaatagctttccgcatctgcttttattttttgtaaaaccatagcagaaatttcttgtggtgaatattgttttccatctatatcaactttatatccagttcccatatgtctctttattgaaataactgttttatctggattagtaattgcttgtcttttagctacttgaccaactaatctttctccatttgcttggaatgatactactgaaggagtagttctagcaccttctgagtttgctataactgttggttctccaccttccataactgctacacatgaatttgtagttcctaaatcaattcctataatctttcccatgatattttcctcctaaaactttattagtttatttaaacttgaatttttcagtttattatttttgaattctatttatatatcttaataagaaacttgttcctatttctaattagcaactttaaccatagtatgtcttattatcttatcatctttcttatatcccttttggaaaacttctgctactacatttttacctaattcttcatcttctatatgcattactgcattatgaagattaggatcaaattctccagtagcgtctatttcttcaacaccaagttttgcaaatgaatctttgcatccctttattgtcatttcaattccttttttcaagtcttcaatactaccatcagctgcaacagctctttctaaattgtcaagaataggaacaatctcttttaatacatctacatatgcatcgctatatattccttctttttctttagctgttctttttctatagttatcatattcagctgttaatcttaaaagtctatcttttgtcgcatctaattcttctctcaatttcttattttcctcttcttgattttttactaaatcttcttgatcttcctcagcagcttctatattttctgaagcctctttgctagcttcatttgtttctgccgcatcattactttcttgagtctcattatccttttctgctacttcatctgcaatttcttctttctctagttcttcatttttaacatctctattttcttccatgtatctaacacacacctcttctctttaaatctaacatctattttggattgctcaatatattattaagctcttttataacttctgacataatcattattacctttgagtaattaatccttctaggtccaattaatccaattttcccaataggcctatccttaaaggaatattcagcagatattatactacaatctctagcttgtggcttgtagttttcatcccctatactgactgttatattgtcttgaggattaaacagctccatcaaagcttctttatcattcaaaagcgatagcatttctttagctttatcaatatcgttatattcaggataattaaatatgttggtagttccctccatgaatacttctgtagaatccgccgagtttagagtctcatataaaataggcaataaagcattgaatatttcttcataggctcctagatccttttttaagttattaattacttctaaattaatttcttgtatagaaagattcaccaatctattatttataacttcatttattcgtgttaaagtttcaacttcaggaactctattatttagcttcattatatgattctttatgacaccagtatctgttaaaaaaactgatactaaattatgatcatcaactttaatcagctgaattgactttataaagctcctttttactgatggtgtctcaattacacaagttaatttagtaagttctgacaataaggcgctagtttgcttaactattttatctacttcaagcattgccgaatcgattatatattgttttatccttagatcttcttcaactgttagcatctgattatccataagctgatcaacatataatctatatcccttactagaaggaattcttcctgcagaagcatgaggttgttctaagtatcccatatcttcaaggtcagccatctcattccttattgttgcggacccaatacctaagttatagtttttagcaatagttcttgatcctacaggatctcctgttcgaatatagtcattgataatagcttgaagtattcttatttttctgtcatcaatactcataacctcacctctttttgttagcactcattaacctcgagtgctaatgactatgtttttaatatattatttatgatgttttttgtcaattctatttatatttattatagctacctaacgttaataataaagcaattttgttaacttagctctttatatctcctattttctccatttttatatgtaatatatttttataattgcgcttaatctttctttaaacttttcataagagaatccattaagataaaatgaaatcactcattacatagtttgatatttctatgccatgcgaagttagatatagatttcccgaattattaattaataatccttttttaatatttttttcaataatttctccatacacttcatatatatctttattaaatcgctctttaaatttctctacttttatcccttcaatcatcctaagccccataaataaaaattcttccatatcatctttaatatcatttaggtgaatttcttcaattacactttctttattatttattcttttaatatattccttaatattgtctatatttttacttctttttttatctataaatgaactagcagacacccccatccctaagtattcatcacatttccaataaactttattatgaaagcactctttgcttttctttgaataattagatatttcatattgatgatatccatacccgttcaatatgtctttagttgtcaaatacataattcgttctttatcctcttcaggtaaattcaacttatcttcttcatataaattataaaaccgagttccttcttctataatcaagctatatgcagatatgtgatctagttcaagttctgctgcttttcgcaaagaacattcccaatcttcaatagtttgattaggcaatccaaacatcaagtctacatttatattattaaatcctagctttctagcaagaaaataattttcttcaaattcttcatagctatgtattcttccaatatcttttaataaagagttttttgttgattgtaatcccatgctaattctattaacattgtgttccttcataatatttagatttttttcatttaatgtacctggattacactccactgtgaactccaaatcatcctttaaattcaatttatttaaagtacctagtagtttttctagacttaagtcattcaagtaggatggcgttcctcctccaataaatatgctacttattctgtattcttttcctttttgtaatatttcattacttaacgcttctatatattcgttcattaatccttcttttcctgaataagatggaaaatcacaataaaaacatttctgtttacaaaaaggaatatgtatatataaagatatatccctcattaatttttcctccaaacattattaaatattttatttgataaaataaagcaaaaataaagaatgaataactagaggagcatttacccttcatttaaacctataaggtgtgtacacctttaatttaaatttcaatagatattctcgcttttatcattcattctttattatttatttttagataatatacatcatacttttttcatatcaaaaactatctatactaataatttttctgcctgttcttttaataaggcaattttactttctgcatctacaacagagaaaccatacacatcaacaaaattgtaaaaataattagcaaatgctattctcttactacgtgttatacccaatgcttcacctagcttttctaaaagttcaacttcttcttcattatattctccatcaataagagcaaggcctattaattcaaaataaataatatttttacatctattagacgaaccttttagattttcacatacggaatttagatctgattctgatatttcactttcatttatgcttagctcttttagatagtcattataaagatttttttcttctttcgcaaaaacattgtctgaatttgcaaggattctaaccaattgcataaatgcaattccttcatttttctttaactcatttaaaaacattcaaacccctcccaaaccggcattaaaataattatttgtataatcctaattaatattatacaaataattcctcaaaaataatatatttttattttatacattcgctagtttttagaattactttttaaataaatataatttacatgtataatgtattctattttatattacttatactaactaatctacctttaataccgccatgaatgcttcttgtggaacttcaacagaaccaacctgtctcattctcttctttccttctttttgcttttcaagtagtttcttctttcttgagatatctccaccataacatttagctaatacatcttttctcatagcttttacggtttcccttgctataattttagatcctactgctgcttgaattggaatttcaaataattgtcttgggataatttcttttagcttttcagctattcctcttcctttatggtaagctctctcctctggaactatcattgataatgcatcaactacatccccatttaataatatatctaacttaactaatttagttctaatatatcctttaaattcatagtctaaagacgcatatcctctagttctagattttaatgtatcaaagaaatcatatataatttcgttcaatggtatatcataatttacaacagctctggtttcttctatatattgcatatctatgtatatacctcttctatcttgacacagctccataactgctccaacatagtcttttggggttattatagatgctttaactactggttcctccatataatccacttctgtcaaaggtggtaggttagttggatttgttatttctaatatttccccatcagttttgattactttatatataacagatggtgcagtagtaattatatctaaattaaattctctttcaactctttcttgaattatttccatatgtaataatcctaagaatccacatctaaatccaaaacctaaagcaatagatgtttctggctcaaagcttaatgccgcatcatttatttgtagcttttcaagagcttctcttaattcatcatactttgctccgtcaactgggtatattcctgaataaaccattggtatagcaggtttataaccaggaagtgctgtttcggttggtctattggcttcagttatagtatccccaactcttgcgtctctaacattctttatggatgctgttacatatccaacatcaccagcacttaactcactgattggaagcactcctggagtaaacactcccacttcagtaacgtcataaactttattagtagccatcaatttaattttagttccaatctttactcttccgtccatcactctaactatacatacaacacccttataactatcgtagtaagaatcaaaaattaatgcttttaaaggagcttcttcatcgccatcaggtgaaggtatagttttaacaacacactctaatacatcacctatattaagccctgttttagcagatatagtaggagcttcttctgctggaattcctattacatcttcaatttctttcttaacttcatcgggtcttgcagaaggcagatcaactttatttattactggtgcaatttccaaatcattatctaatgctaaatagcaattagctaaagtttgggcttgaataccttgtgttgcatcaacaactaatatcgctccttcgcaagctgctaaacttcttgaaacttcataattaaaatctacatgtcctggagtgtcaattaaattaagaatgtattcttcaccatcgtctcttctatatacaagcctcgctgcttgagactttattgtaattcctctttctttttctatctccatattatctagaacttgctcttccatttcccttttagttaaggttcctgtagtttcaagtaatctatccgcaagggttgatttaccatgatcaatatgtgctacaattgaaaaatttctgatatgtttttgtctttcacttttcatacgcataactgttatccttaacgaaaaacagtcctttcacccccgttataattaaatcagctaaattataacatatatccataaagaaaggctatcaaaactttccctcaatgctctatgtctaatatgccttatatatattttaaaatcaactaaataatttaactaatattatggttttattctttcaattatatcctctatttttttaataaaagaagattgattatttatcctaaaatcattacttcctatcttaactaaaacatctttttcagattctttataaattttaagaaatgaattatccttgataaaattcgagaaatcttctccaaattcattgcttacaagtttataattttcattagtatttccaagaggagataatgctttagtattaatcatatctattttaattattccaataaaaataataaataatataaaaatcattggtgatattcttcttaaaatgttacttttaataattttcttcaatgtcgaaacaccctttttaatttattttttgatttttatttagattctttccatatagtcaaactattattcaccctcaactttctcagtcaaacaatctactcaccaattatctcaatattatgtattaataaattaaaataaagaaaagactagggatctaaattctagctttagactcctaatctttcctttaatttttatcatcaagattatatttaaatctcaacttgaaatatctatttaaatacttagtgctaaaaatcaaacttgcatgttatctaacttttcctatgcactcaatataacttccaaaccttttccatgtaactttatacttatttcttattcaaaacttccgcaattactctagccatacattctgccgtaacttttgactcgtctggtgtattagtatgagatcctatttcaaaaagtaaacatccatcgcttttactttgattaaatgcatttttccctctatgatatgttaatatttttataggcaatcctgggaataattcagatgttttattaaatactttctctgtaagctctttatttttaggatatctcgtactattttcagcatttacaaacattattttagatgcgctcattccatcaacttctgttgttgtcgcagctttatcttctacggaatctctatgcagatctataaccattttgaaatctccatattgttttaaatatttatcaaccacttctccagatcttgtataactatcattataagaaatacaattattggttttatcatgtataactgaaatcccataattctcttctaattcattagcaagaacatcgcctactcccactacattggtatcttcatttaaactatctggttctgatgcattataattttctgtagtatgactatgatatattaatacttctggcttagatttatccaatgtcttctttaagctaggatcatatattggggtattcttactatcagtgtttacttgtacttttgatatactgtcttcgcttatttgaaacggattaaaactaaaattagtttcagtattgctagaactttctccatcaccaaagaaactaagttcattttgaattattcctttatagctaagattatttaatcctaatacttgaaaacaaacattctttaatgaaagtttattttcagcataggttccttcatcataaacttgggattctattatcggcattcctaaatttaacaattgaacataggcaaatgctcctctttctttgttattttttaaaacattacctaatcttatgaaaaatacacctataattaaaatgaggattattaagcctatattaatgttaggttttgcttttatccttttattaatttcacctttttttcctcttctgctcatatatatcacggtaatcccccccttgcccttttttatatttatattaacggatttacataattattctaataaatatcattctatctatttaaaaattagaatagattaaaatatatattaataatcaatctaaaataaaaagatcccaaaataattcaaattactttgagatcttttcttcttattctaaatttcaagaaataaattattaataatcaacccataaacttattaatctcatccatatccatattaggttggactgccatgtttatcccattggctattattcttgataaagaattaaccattaaatcaatgtccttaggtgtaactatcatatccatacttgcttttgatgacatcacttccttaatgagtctttccttctcatttttatcaagagattttaacattttataaaattcatttccacttgatgaattatttattaatgaatctattacagagtctatagtatcattagcaattgttgttgcatctacaactgttggaattcctaccgcaataaccttaactcctaaatttttttcatttatttgttttctattattgcctactcctgcacccggcgatattccagtatctccaatttgaattgttgtgttgactctttcaactcttcttgcagctagagcatctatacatatcactaggtctggtttaattttttccacaacgcctttaattatttccacagtttcgattcctgtaactccaagcactccaggcgctatagagcaaacaggtcttacagactcatcaattgcttctggcataactgtttgtaaatgcctagttaccataatcttttctgtcactttagggcctaaagcatctggtgtcacttgccagtttccaagtcctacaactaatactgttttctctgtattaatcctaattaatctttgcaaaatctctgatactacttgtgaaactctatccatagtttcaccatcatatgctgtaaagtctggcattcctatagttatataatttccctttggctttccaatttttttagcaccttcatcattttttacctttactgtagttaccttaatatcatcatcactttcttctataacttctattccatctatatctacttcatccttgtgactttctttataaatttctctcgcttcaagtactaaatccgttcttacatttatcataccaacacctctttataaatttactcagtcttatttttcctttttctttgaatttaatacttgaattacataacttctgatgctataataaggtttgttgaatatgaactcgtacgcagatttccccaaaaactgcagagaccctataaaaatttaagggggtgaattaagaatggcaaatataaaatcagcaaaaaagagaattaaagttactgaaactaagactttaaagaacagaatgattaagtctgctttaaagactactataaagaaatttgaagctgctatagaagctaagaataatgaagaagctaaagctttatttacatcagttgttaagtcattagatatggctgctactaagggagttgttcataaaaatatggctgctagaaagaaatcaagattagctgctaagttaaactctatggcataatcttaaaacccatctaagtagatgggttatttttttattctttaggaatttatattctagtaaaacctgtggataacttataaaaggttgattgaatagttttggtattttaaaaagaataaaaagaaatcttattcgcctgccaaatttttctcacatgcgttctaaaaggcagatgcgtgaaaaaaatcttcggctccacagtcgcctgcgatttttttatattcttaataaatattattttttaactgtaagtgtatttattaaaaggaattccatttccatattcttatctattccagttgattttaactttgtttctgtattaacgcaaagcttaattaactctgataactgcttttctgtgaatttatttgtctgcattattaatttttcacaaacaaactgcggcaacctatagtctgacataaaatcatctactttttttccattgctaagttttatctttatctcatataatctcaagaaatgcttttgaatagcacttattatcagcatatgctggtctgatttatataaaatttccttcatagtatctatagctttatcaatttttttggtagctattaattcaactaaatcaaaagtatcatcctcacttgattttgaaataagtatatcaatatcctctttttttatctctctttcaccacaatacgatataagcttgtcagcttctctttttataatgtcaaaattattataaactttctcacagaaataagataactcagttcttccaatttgttttcccttctctttaaatacttccgatactttctttaaatatttgtccctttttaatttatcacaatatactattgttaatgatttaccaatagtagctaatttcttatttttatttggtctatctctcttatcattcaataaataatacattattaatactgtatatggaggtaaatttgatatatagctcttaatatcattgtatattttagttcctgacgaatcagttttgtcctgtaaaaaattagacctataaacaaccacaacttttttttctcccatgaatggcattgtttcacacgcattcatgatagcatcaaaacttgtattcattccatctatccttattaaattaagatccataaattcttcagctatattcttttttataatcagacttattccatctttaataaattcttcatctaacccacaaaatatatatccattttttatatttcctttttcaatctcttgctcataaacttcgtaattaatcactttaattttcctttcgtataaaatgtgcttctaatttaattctaatataaatctataaacctatactaatattccgtctattataaatatgttattagtgatcctatcattaaaatttattatatcatactcttcatgttgagttttatcacttgtaacttttaatagatattttttagtaccagtatctagaacgtaatcttttcctttgaaacttattttataaattccattcataataatcgtacttctctgtctaaaatattttgttgcaagtgctgatttagaaagtctatttaaatcaatttgatttttattggacattagtattctatcacctttataagaaaataaaatagcaccttctttataataccttatacttggaattggactatatatctgaattgtaattataaaaatagctataagaggaagataaacaaactttttatatcctttattcacaaagtaagcactaaacattaaaaatagatagaagaaaactacattttcatttccataaaacattggcaatgaaaagttctccatataatttagaatacaatcaaacatatttattattttcaagtttatataactgcaaaaatcaaataattgagtataagtatatgtcaataccaatgcatttcctgtaataaccataagatctacaaatggagccaaaattaagtttccaataataaaatttgctgaaaaatccctaaaaattaaaattagatatggtaacgtaaatatctgagcgcttaatgttaaacttaatgcttctcttaatttaatgttcaatttatataatgtattgttaaacttcttattaaacattgctattcccaaagtagctaaataagataagtgaaaagatatattaaaaatactataaggttcataaagaaccaaaaatgttgcagagaaacacagagcagaaattgaattattatttctttttaaaatacgtccaccttctacacatgcaagcattaaaaaagaccttatactagaataattgagtcctgtaaatacaatatatatcatagttaccaaaattcctaaatttctcccaacaaaaattcttataaaaccatatactatagctacatgtaaccctgaaacgcttatgctatgtatgattccaaagtttttcatgtcatctttgtcttcaaaatctaaataatcgcaataaccaaaagcaattgatgatattagccctgcctttcttgttcctaaattttcttctaaccgcaaatatatatttcttttaatctcataaagctttgttatcaagtctccattaatcttatacaatactttaggctctacttccccaactatcccattatatctatcttgtatgtcatcaacttttcctataattttatatttttcacctactcttaaattcttatcattagttcttatcgtaatactcttaccttcatagcttcctataacactataattgcttatttttattatccttacttcgccgcctattttgcttggaattttataataggaacaattaattaaaattccaacaacaaaaaagataatcataataacaaagaaactgaaaccacaataataaaatatgcatataaaaaagaaggctacaatgaatattgtaagccccctaaattccttattcattccatagaaaatacaactaattgcaagcgtcaaaaatatgtatattagtggatttcctacatctcctatttttttagaaaacatcaactcacctcattaatgagttttgccactttctagctaaaatttcaaagattaataaaaatattatcgatgctgctatttctattcctattatatctctaattaatattccattaattagaatcatactaattacggcaataataattactaacaatgatataacaggcataatcaattcattagaaaattttcttatagaaatattgctattaaacaatgtaaataataaaattccaattgataatatagttaatgtcactatcgctgcttccttatcaccaagtttgtaaattgaaaccattgtaattatgcttagaacaaatgatctaactatcatttcatttctagtaatatctcgcccttttttaagtaatattattaatgataatggaatgaataaaactccatttatcgttaccacatttccaaaatccaaacttccagtttgtcccattataatacttcctactaaagttagaagttctgagaatagagcaatgaaatatactttgaatcctctatctatattgccatcaaatactctggaaaaatctcttattttaaagaacccatctaggtaattttctttaatatatacatctgataccttttttacaattgtagatgcttttcccttacctattcctacgtttgataagttgagtgctggaagatcgcctaacgtttcaccagtagttgcaactttatggccatcttttataaataatgaaacaatctttgatttaatttctggatttactctgcaaaaaacccttaccctacaaagcaaatcctttaattcttgatgatttaaagaatccagttctattcctgctactacctgattattattctttattatattagccatttttgcatttgttatagcacttaatttactttcttctgtaaataatattggtactattgctttatccttaattcgatttattgtattttcgagattctcttcaagtggattttccaatccaattattccaacaaagaccatgttgctttctatattttcagatttagatggttcataagtaaagtttctatacgcaaaaccttctgttattaacccttctatagataaattcatatcaacttcctttatttttgctttgtattcatccgtaatctctttctcgataccttctatcatgacatgtgtacattgttctaaaacatcatctacgtttcctctagtattagctctatatctgttattaaatttacttacaactgtagagaatcttttatcagaatccataggtatatctaaaattttagaattcctactatctatagcagctttgtagattttttttctagcagcataacttagaaaagcaagctcatctaactctccttttccactatcatcacttggattataaatagcgttattacatactaatgatatttcaactatcctatcaaaggttgtctcttttacatacggatcttcagtcgatatcaaattatcgttaataaatagttttttgactatcatttcttttttgcttattgcaccaactttatctaaaaataaaatattaacatctttaattaaattaaatactgaaaaatttattatttctatattttcattcctaaagcttttaattatatttttaaaaactaatttcgcgattatagtaactggaaaacaaccaagggcaaataaagctgtgcatatgtaatttttgtttgcatcttgtcctgtatatacaaaatatgatcctataattataattcctaggaaataaattaataaatatctttctaaaattttagatatcattgtcccaaaattatgttttctattacttgcatacgtaagcatggtaagcattctacctaactgagtagaattaccagtggatattactatacctagtccgctacctgattttattatagaccctttaaacaatatatttttcatatctgttaaagaaaatatatttcctactatcttactttcaaatttctccttataaaatgcttctcctgttatactcttttcgtcaactttaatttcattagcacttattattcttatatctgatggaataacagagtctttattaatttttactatatcgcccattactaattcttcagattttataattttctgggctccatctctaataactactgtatctgcagaattcagcctttctaaagctccaatttctttatctctttttatagtatgcattactattaaaattaaatttaataataatatcaaggctgttattataccaaataaataatgttcaaatacgaataaaattattgtaattatcaaatttataattatagatttttgctttaaagcatttagtatatgtttataaattttatttccacttggtaaatcaatcttattggtcccatattttaatcttaatgcttcacaatcattttcactaagtccactttgaacattactatttagtaattcaactatttgagcccaagagttattgcagtatttttccaaaaaaaccccaccattctaattacttcattaataacttctttattatactatatttttcatttttatatatatacattcatttatagtataattatacgtttaaagacattaaaaggcaaaactttaatatcttatatatattttcgatacatatttataaaagttaattttatctgagcatttctactataataatcttcattgggctcaattatttttccatattaaatttatttattttttggtttttggattaaagattagtgccataagatatccaaagaatattgatgctgtaattcctgctgcagctcctttaattccacctgtaaaagctcctaataatcctatttcatctacctcttttattgcagctttagctaatgcatttccaaagctcggtaacggaactgtagctcccgctccgccaatagaaactaatttatcataccatccaaaagcacctactatagctccaagcacaacaaacactactaagattcttcctggagttaattttgtgacgtctattaatatttgacctataacgcaaataatgcccccaactatgaatgcacttatataattcattcacttttcattcctttcaaacaaaagatttttataatctaacatctcgtttatttataagtttcctcttacttaatttgaattcatttcaatagcgactgcatgtgctattcctggaattgtctcaccttgaagagaagacgtagtgctcataagtgcacctgtagaaactaataatactcttttaatttcctttttcataagtcttttatataaataacctgtaaaaacaactgctgaacatccacaaccacttccacctgacaatgtattctgcttttcattatcaaatataatttcgccgcaatctatatgttgatttctaatattatatccaaagtcttcaattaatttatcagcaagttctcttcctattacgcctaaatctcctgtagctataacatcataatcttccggttttcttcctgtatccttaaaatgatttacaattgtatctgccgctgctggcgccatagctgctcccatattattagcatctttttgcccataatctttaacttttcctgttgtcacatatgttatttccggataattcccctcatgtcctaaaattaatgctcctgatccagtcactgtccactgagctgtggctggtctctgagatccatattcaagcggaaatctgaactgcctttcggctgaactaaaatgtgaagatgtagctgcaaccacgtatttagcaaatcctccatccataattattgacgctaaactcaaagattctgacatagtagaacaagcaccgtataatccaaagaatggaatactgaattctctagctgcaaagcttgatgaaataatttggtttaataggtctcctgaaaataaataatctatatctgtttctttaaggttccctttttttaaagcttgcgatatagctgtaaacatcatctcgctttcggctttttcaaaactttcctttcctaacatgtcatcgtttaatatctcatcaaaatatttacttagcggtccttccccttctttggggcctactatagaatgcgttgatattattttaggtggattatctaattttacagtttgatttcctatctttttattcttcatttgcaaattaatcactcctctacatttttgaattaaaaacaactttattatttatcaaaaaaatacatatccccatcttaaaatttcaattccttttttcatttaaattattgaaattatataataaattattcctattattactgatgtaccaataccatataccaatactggtcctgcaattgtaaacattttggctgcgactccaaatataaatccttcttttttaaactctattgctggagaaactacagcattagaaaacccagttatcggaacaacagtaccagctccaccaaaattagctaattttgcatatactccagtacctgttaacaaagctcctaaaaataccattataataggaaccatattcattatttgttcttctgcaattccaaatcctgctgcaatattgtaaatcaactgacctacatcgcatatcaatcctccaactaaaaacgcttttaagcaatctttaagtatctttgattttggaatggcttcattggccatatcattatatttttgctttatgctttcttcacttacttctttattattagtcaagatgatcactctccttttttacctgtatatctatcatttgcaaaattattaagattaatcgtgttattttttggcatatattttataaaaaaatagaatatatatttgatctaatttaataaaaaattatacaaatacatattctataataactcttttttatgtttatcatttttcttaccaatgtgtaattagcaaattttattcttctaattttttccgcatttcagctaaaaccttcttttcaattctcgatacctgcacttggcttatacctaacattttagctacttgaacttgtgttttatctttaaaataacgtaacattataatctgcttagctttattatctaaactatttaatgcttctttaagagctatcttttcaataagattttcatcatctgcacttttctcacttagtttatctattaaaagaactggagctccgtcatcctgatgtattgtatcatataagtattgtaagctattagaagattcaattgcaaataagatctcctccttatcaacatttgcataatctgcaagctcttctatagtaggtgatctcttaagcttttttgttaaaatctctttctgaaaatgtatctttctagcaaggcttttaacattacgacttacctttatcatcccatcatctcttaaaaatctctttatttctcctataatcatagggactgcataagtagagaacttaacattataatttaagtcgaaattattaatagctttaactaacccaatagatcctatttgaaatatatcttcataatcatatcccctatttagaaatttcttacttatagatgacaccaatggcaaattcatttctattaatgtattcatagcatcagtatcgccacttcttgctagagctaatagctttggattcttatcataattataatcctctcgttttaaatcctctttttccatcttatttcacctaacttaccacgttaaatttcttcttaattaccacctttgtaccattacctttttcactgtcaacctctaacgcatccataaatgtctccattacagtgaatcccataccagatctttccaaatcaggtcttgatgtatataatggctccatagcttgctctatgttatcaattccaattcctttatcaataatcgctatagttacttgatcttcattaatttctgcttcaattctaactaatccatcttctctattttcatatccatgtattatagaattagtaactgcctcagacactgctgtttttacatcatttatttcatcaattgttggatctaattgagcaacaaaagctgcaactgcaactcttgcaaaagcttcattttcagatttgcttacaaattctatgctcattttattgtcagacatgataacccctccatctaaatgcaccttactgcttcatctacagtattataatttttaattaacttgtacaatccggccagttcaaaaattctattaacattcttattaggttctgcaatacaaagcatcccccctttgttcgatagttttttatatctacccaagacagctccaattcctgaactatccataaaagtaactcctgaaaaatttaaaataactttttctatattatctctatctatcctatcatcaatttttactctaacttcctctgcactattatgatctagttcaccactaagagtagttattagaatatttttttgtttctcaaattttaaatacatattaattaagaatatctcacaatgtagttttaaacttatatatttaagttttaagatattctacgttcacctcctcttttccctcatttcaccttttaccatattttaacatactattttattcaacgtcaaactatttattacatttttttctatttattataactcattatcttaattatccgcctatatcacatatattaacgatgtataaaataaagataccgataattaactacactacataattatcaaatattaaatgaatatattatttttgcctaatacataaaaaatagaagataatcccaatatactcatataaatatatatcataagatcatcttctattttattttcttatagatatccaatttaagaattaaacttatgaatagtaatttctagcataaactaatgatttaaccatgttaaaatcttcatttaaatgaatatatattgaatttactgattcaaaaagctcatcaatagatataaaagcactagtactaaaaatacaatttttcaacttattccagatattttcttgtgggtttagaatcggagaatatctaggagtatttattaaaaacaattcttcgctatgcgcgtcagcgaagtcttgtattattctagaggtatgaaatttagcattatccagtaaaacatatacctttttaccgacatgtattttaagcagtctttcaagaaaaacttcaacttcgtgtgatttaatcgaatgtttagctggataagcatccataatagtatcaaagttcttggagatttctgttgcacctattatattgattccctcgtgagagttgttactttctaaaataggggatacgccaatttgactccaagatctgcgaatatcagactctgttctaagtccggtttcgtctaaagaatatagaacataatcagaagaattttctacagtagagagaaggcatcgcattttttttaaagacttcttgttcggccttatcagctttagttgcgctcgtttatagctcaaattacttctttttagtaacactcgtatatattcaactgaatattttattccataattctgatatatatatgtcgctaaaagagggcaagtccatacattaccgatgaatccaaaatcatttggatgcgtatttagaacagtatttactaaatcatccttcatttcagctgtaaaagttcctccggtcaaagcaccacggccatctttaagtgccttaagaccgacggaattccagctttttatataatgaataactgttgatttagtttttaataaaaactttgatatttcaatagtactattcccttcatatctcatgattacagctgttaacacgttacgagcaaattcgtctttagatgaatttctcattttcttaagattttcaaccgtccaattatataacgatgttacttcaataccttttctacccatagctatttctccttacaaaaattaactagtactagtttgtgtaaaaatagctatgctatgcataagtgtatttctaagtttggatatctatatagataaccaaactataagttagatttatactatgaaatatatctcaactagaaataagttcatatcttagttgtgatatctaacttaaagatttgacttattagataagccaataattactttttcttttttccacccttatattttaaaatttcattttctatttccttaaagaaactttttactgattctccttcatcaagtattaatacttcaatagcatcctctaaagtttccatggtatatatatgaaactttccatttctaacatcatcttcaacttcatatcttaatattaattcatcggcatttgtacttggaattaagacacctttcccatctgttttatcaataatgctgcaaactctatggaatccttcaattttttcattgaccccaccaattgcctgaatttctccaaactgatttatagatccagtgacagcaatattttgtcttattggcctcttacttaaagctgatagaatacatattatctctgccacagaagcactatctccttcaagcattccataagtctgttcaaaacttaattgaaaatctactggcaatttttcataaggacttattaaattacttaatagtcctcgcaatattccaatcgatttttcatggatatttccactcattttgcattctttatgaacatctattatccttccatctcctatatttgacaagcatgttatcctcataggcttaccaaaactataggatccatttccaactacagaaagcccattgattattcctgtttttcttccgtttactgttatcaatatttttttacttttataattatccattatatcttccaaaatcttttcatcttcatatgctacatcaattatatcttgcttttctatattttttcttttatcttcttttgcattattattggatagatgcagtaatttatttatataataatcatctatagatattttatttctttgacctgcgaccctagcaaggaatttaatcatttccttaagagcatcatctgttatattcaataagttatctttttttatcttttcttttattaatccttcaatagaatttttagtaatatcattatattttaattcggtatccgcttctatcctaattgggaatatttgtttaaaatcttcatcattatcatataatatctgaaaactctcatagtctcctattaaaataaccttcaaattaataggaattgactctggctttaatcctgcgagagatatcatttctaaatagctcttcgtataattatagtttattttgccatgaattaatgatttctttagatagtagtagcttacaccactacttattaacgaacttaatcttaatataagacatccttcattagcctttaacaaactaccagcagaaatcaaagatatatctgtactatatccaccgttattgtttctatattcaatggtaccaattaagtttccaatagtaggatcttcatcatagataactctcggatgatctatggcggaattatcaacaattacatttacattataattagagaatatatcttttagacaatcttcatcatcttccaaattaatagtataacactcaactactctttcttctatatcatcatacatttgaagaagatatttataaacatcatcctgggaaataaattgtaacaataaatcatccttatgactctgcatattcttttttataaaatctttgtatatacttttaagtttcttaatggattttatttcaatatcttttaatgtctctagaatttcctctgcttctttttttaattttgatgcttgtttttcgatgctttcttgagtgttactttcgagactgtcatattcattttgagtcatctcattgccttcatctttcaaaggaataaacacaaatcctccgctagttgctttaacatcaaaattcttattttttgctgaatccataagttttgttatataattattccttttttcacttatttcttcaataatatcttccttttcctcatctgaagaactgttataaaactctactatgcattcaaagtatttctcttttatatcatcaatcatttcttttaatatatttcctttaccatttggtaaaaacaatgcagtaggatttagttgttcttgtgaggttacatagcaaatatcttttggtgcaggaagtttttcatatatattttcaacacactctattaaattctctagtttctcttttgaaaatgaatctacgtaatatatattgtatccttctttttcaacactcaagctctttttaattctatttaaagtagatgtaaattcgggtactctattaatattactttttttaatgttatctgtacacgaagtacaaaaaataatttcatttggagttaattctttcttcatatcttatcccactttgaatctattatatacttaattaaaatatttcaaagcagacccctccctaaattgatagtatataatattaatattctttaaatggcaaaatagatatatttttttataaactaaaacataaataatattaaaaatcagaataaaatcataggcaaccgtgaagttcgaagtttttttatacctctgtcttttccaactcatatgagaaaaatatagcattaaataaaaaatgatcacctagatattaatcttagcaaccatcttaaaaatattaattacatggaatataaacaacttacatttcatttaacatccaaataaaaaaattcaatactcctgcatatactaaccaagccagataaggaattaatagaaatgccttatttccaatcttttcataaaacctctttatagttaaaattacaaagataatcaaaataataagttctaaaaatgctaacgcataaagcttaaacccaaagaaaattatagtccataaaaaatttaataatagttgtatggcgtaaacaaatattgcagagcttacatctttattctcatattttaaaatatatactttatatgagcatattcccataattatataaagtatggtccacacaatcggaaaaactattgcaggcggtgaaaaaggtggcttaattaagctttcatatattgatctcatattaggaactaataatgttgaaagccaccctatcaaaagtggaataattattgatacaaacaatggaataattcttatcttttttttattccctgacttttctgacataaattatacacctcaaatttaagtaattagtttaacataactaatttaatatatgtttatttatgtaaaactatgattaattaataagactatttattacaagtttatttatatcaaattgtaattatttttagtacctataaatttattaaattcatatccacttacttttttcatttcctattaagctaattctactcaatatatatatccgaaaactctatatctatcttttcttctaataaatttgtttcccaatcttcattattgaatttatcttcatgtaattgctgagccataggcataattattgtgaattcatttcctctattatttgatgtgagccgtatatttccttcttgaagttcaactaaggctttagttagaaataaccctaaaccgcttccttcttttagtctattaaaagttttattcagtttagtgaatttatcaaaaatatatggaatggtttctttatcaattttcaagccatcatttttaacttttatagaaactttgttatccttatcaagctctacactcacatttatttttccaccttgctttccatatttaacagaattggaaagaatatttaacataattctagttatcatctccttatcacacttaacatagatttcctcttcctgtgcatcaaatgtcagagtattatttattaattttatgtacttattagacgccatcgaaacctcttctactatgttaactatattatgtatttttagattcggaattagatacccctctgaaattttattagcatctataaaattattaatagtccttataagccttaaacaattttgctttataatctttctattcttatttactccatctagattattttcattaaaataaatttgattaacctgcaatgcagaaaatataagatttataggcgtttttagttcatgagaaatattagagaaaaattctttttttatttcatcctcttgcaagtattcttcaagaatttctctcatctttttattttctttaatttcacttatatcatgtatgtaaagaatcttgcttatttcatctatggaagccaaaaatatttcaacttcgaaatcagtatgtttcatttttatgcatggaatataattacctgctctcttaatatcttcaagcgttatatcaaaatacatctttataaaatcatttatttctattcctaagatctcatcattagttatgtttaaagtttttaatgtcctcttatttatgtgtcgaagcctatctaggtaaaatagaaatacaccaccataaatagaatcaattagttcattattcctatctccactctttttgatcattacacttatttcatttaatatagaattccttttccttaatatagagttaagttctttctttgttttagttgcattgcctatattattattaagttcttttaatgaactatccactactttacttattatgtaatcataaaatttatataaagtaatacatttaacaattaatataaattcagaaactttcacatagttcatataaaggcatataaatcccaaataattaaataatatagaaaaaatataaaatattatttgtctaaattcatcaattgtaaattgctttcttttagataaagtatcttgtactgtagatatacacaaacctatacttaacaaaacacttatggtaatgcaccatataaaaagtgatagttcataaggattatgtattccattccctccattaaagctaataacaagcattatactgattagtatttctgatatacatattataagactctttctatcattatttttaaccacgagtcctacttttattatgcagtactctaaagtagcatgcatgctataaagaagtatgaagtaacttttagaaatatccttaaataacattattatctcagtaacatttatagctagtatcataataagtattaaatatatcactttgaatcttgctacaaaacctttaccgacaaacttcccccttattatatacacataaataaacgccaaaatcatagatattgcaattatattattcaatagcaaataaaaattaacattatcagtaagaatagagcataaaattattagtaccgttaaaaatgcatacttctgaatgtttctaatttttatctttattttgtccaatgctaagaaaccattatacatctctatatccctttcctaaattcaatacttacagttgtccctaaattattatttctttttatttcgatttttccgccttgtagttcaattaattgttttactacaaagagtcctatgcctgtcccactttttcggtcaggattacaatttcctccaattgaatatctattaaatgcttcgtatataaattcctcatctattccaatcccattatcttttacagatatattgaccttatcatcagattcgtttaccaccacgcatatttgtccaccatctttagtaaatttcacagcattagaaactaaatttaggattattctatacataaattcacgatcaatatccaagtaacactcttcagtattagtatcaaaaattaaatctatattatttaacttcacatattctactaatgacattacattgtcctctatgacctcaactatgttcatattctctaatcttggcgttaaataatgggaatttatctttgaattatctattaaattgttggttaatttaattaaagagatacagttttgcttagatatatcattatatttctttaatatatcaaagtcttgtttttcaacatatattttttctacctgcattgccgaatatattacatttatcggtgttttcaaatcatgacttatatttgaaagaaattctctcctaatactttcttcaatttgtttattctcaacttctttccttatttcatccacaagaactttagaagttctatctttaatcaatagcaatttccatgatacattttcataataaggcaaaaattctgcctttataaatttcttttgatttcctatataaagaattgcatcataatctttattttctgcattattatttacaaaatcaatataattgcttatttttttatttattatttctcttttttttgagattcccgaaatctttaaaaattgtttattcacaaataatattctatcattatctgcattcagaattataattggatggggcataaacctaaataatgttgaatataaatactctttacttcttaataaatttattgaactctctaacttagcatttcctaattctatttcatgatttagttcatctagttccccatttttatcattcaacgaacgtgataaggccttatatggatctttaaccaacctagatataataaaattccaaagcattgtaaagtttgcaaaatgtataacttcaattaatgcatcttttatatattggccattgttaaatgcatatatattaattaaaaatatcagaaccgttgaggatatgtaaacttttatgatgctccatccatgttcccttaagtagtttgatttttttaaattcataactatttttataaatgctggtatctcaataaccgtatatataattttcacaaagagtatagtcaaattagaaaaataactcagtaacgtacatgtaataattaaaattaatattccgtaactttctatctttaattttcttctttccaaataatattcagttaatacataactagcaaaagtttctattagtaatatactctctctgcttaaatttatataatttttaatttctattaagctatttgcatcataaattttcattataaatccaaacgatgatataaatatcattaatgagaaaaatattattattatcttcgaaacatatcttttgtaaaatcttctcacttgctttaataatacaaataaaattatacttagggttatgtaataaattctaaaaattaaaggtatatgtacactagcatcattaacaataaattttaatataaaatataaaaatatacttatcatataaatatatatgattatagatttactcataacaaaatcatttgatagtcttttatacttttccatttttccccctattttatgaaactataaccttattatatcattttcttctattatgccaccttacttttataaataaatgtatacaattaattttttgcagaaaaaaatagccagcaatcagttgtgttgactatttattccaattaataataattttattttaacaactactaatgtctcaatattccactcttttttaatttctccataaaattatttgtaatactgttcataaatccttttaataatattccagcaattaatgaaacaaacatgtatatagacaaaactgctatgtctttaatcaatattgaatacactattcccgccataatctgtctcataccactaattgcatatgtaaaaggcaaaaaaggaaacaatttttgaaaaaatactggtgcaacttcaatcggaaagttaccacttgctcctgccatctgaagtactaatattataacaattgcggctttccctacatcatctagtatacttgctgcagtatatataacaattacaaatataatacttacaaatatactataaaaaatatacattataggatgaactgcataaacctttagcataattaagctacctatacttgcaactaatgcttggcatactccaactgtcaaaaataataatagttttcctaaatacatttcatatggtttaatccttgttccatcatcaaatttaggtgcttcaagcgataataaagccgatgccaacaatcccccaacccataagcaaagtacggtataaaatggagtcgtagctgtgccgtaattaggccatggaaataatctattatcttctatttcaactggactcgctacaaaatcactttgattttcccaattgcttgtcatcatgtccaataattcatcaattttatcttcttcatccatgtccttgattttatctgccaattcatgaatcttatttttagcgtctggtaatttgttttttaaactatttaattcatcattagttaaattggtagcatcctgtgaaatacttagcaatttttctacctctggtaaagtatttctaccttcatcaataatagataagctatcgtctaaaacgtttctagttgaattaatacttttttctactcctgagacaatttctgaatcataattgtctgtaatatttgccaccaaactatgtacttcatctacaacttctataatatccttaagtgtttgaacatttaatccttcattatctattttcttaatttcttcatccgatttatcagctactatttgtagtttatcttcaatcgtatctagcttatcactattatctgaaattattttacctatatctttcaaatcatcttgcatattttttacagaatttaattgtttatctagtttgtctgttattaattttatcgaatctatattaggaacattatcaccaaatgaaggtattttgatctctatatcacttaatttatcaataagtttctttatatttctaagtttatatttaacattattaattgtttcttctgttgcaatagcagaatcccttatatttaataacacctttttagatacttctggtaatacattctcatctatatttttaagttctacactcgaattatcaagtacattttctgattttattaagtcctgctttactgttggagaaatgtctgatagttttccttgagtatcatctaaaaccgatttactattatttaaaaaatcacttgatgaatcaatagcattagatattgttggaagcatatcattagttttagttaacacatttttcaaatcaactgttccgttgcttgcatcatctaaaagtgtttctatttctgacacattatcatctaactcatatatgttatcaactatttttctaagcttaggtctattgtcttgtatatcaactcctctttcgttacatatcctaaacaatattcctgagactgtcttaattacattttcgtctaactcattttttactgtttttatacctgaatctgtcattttaggagcaatcgcatttttcttttcatttactgtgtatattaactttggtttattaatatttttttctaacaatgttgtaatgtcttcagaaaagttttctggaatttcaattgttgcataatacttttctagtagcaaaccttgctccccattttccttatctgtaaaaacccatcctaatttgtcattttccttgagtttatcaactaaatcttctcctaaatttatattcttgtccttaaatacagtccctttatcctcattaataatagcaatcttaattccagctgtattggaataagggtcccatgaagcctttatatttatcaatgagtacatagatggaataattatcattaccataatcataagtcttgctacccaattagtacgtattttattgatatctcttttatatattctaaatatattcttcataattaattcccctaatattgcaatatagattattttaactactcattattgaactttcttttaatttttcaacaatatttattctttttgcatttatcggttctttagccaaaactccaataataattgatcctatcataaacataaataatataatgctatctttaaataatattgaatatattactcctgccataatttgtctaactccacttattgcataggtaaacggaagaaatggaaatagcttttgatatcctgtcggattaacttctattgggaaattcccactagttccggcaacctgtataacaagtaataccacacctatgactattcctccatacccaaaaagactaacagctgtgtaaattatgcaattaaatacaacacttataaatatacaatagaagacaaacattattggatgtactgaataagaatgcaatataaataatgctcctagactagctattaacgcttgacctattcctatgaataaaaataacgatagccttccaaaatatttctcgtacttatttaattctttatcattttctatagaatgtgcctctgttccaattaggactgataatacatatcccccaatccataagcaaagaactgtataaaatggcgttactgtagatccataattaggccatgggaataatctattatcctgaatttctacaggactagataaaaaatcactttgagcgttccaatcatttgttatcatatctaataattcatcaatatctttcttgttatctattttcttaagtctctgcgcaagctcatgtacattgtctcttatatctggaaacttctcttttaatttttttaattcatcattagataaatctgctgtattcttgaaagtattcaacatctcttgaacatctggcaaagttttttttccttgagccgataagtttaacccagtatcaattatctttctcattgagtcaaaccccttattaattgttggtacaatttctgaatcataattatctgttatatcagaaactaaattatgcaaatcatctaatacttttctagtatctgtaagatcctgcgtgtccaatattttatctccactatttaatttatcaatatctttattagttctatcaattaatttatcaagattattatctatattatctaacctatctataattttagagattgtcctactctcttgctttaacaaatctctttgattttcaattacatctgcttgtttatcaaaaacttgctgaagcttttttatttcatcatagctttgtagtgagttgtcaattgaaggtttaggaatttctatttcgctaatcttatcaatagctttttttatgttcttcaatctagacttagcatcgctagaactagttctaattgctttagaagtgtctaatatctgtaacaatgctttcttttctacttctggtgatatattttcatcaatatttttaagctctgttcctataatatccagcgtattttcacattcaacaagatcttctttaacttttggagattcattctgcaaatctccttgtgtttcatttagaaaactttgtgtattatttaaaaattcagcagtttcatcaacagtgtctgctgcagttggtataagctcatttgtttttatcattaactcagaagcacttattgttccattaattgcttcatttagcattttttcaatttctggcatattatcatctaatttgtatactgaatctattatatttctaagctcagatctattgttttgtatatctataccaatctcatcacataatctgaacattattcccgatatactctttgctatattctcatctaattgagttttgacactttttacacctgcatcagttattttagatgcaataacatttttcttctcatttacagtatatattaacttaggttttgtaacgtctttcttaactacagtcgtaacatcctctgaaaaatcttgtggtatttcaatcattgcataatacttttcatttgttaaaccatttttggcagtttctttgtctacaaatacccatcctaattgatcattttccttgagcttatcaactaattcatcgcctaaatttatactatgttctttgtataccgttcccctatcttcattaacaattgcaacttctattccctttgtattagaatatggatcccaggatgcctcaatatttattaatgaatataaagatggtattatcattaaaactactacaacaagcgctgccacccagttagtaaatatattcttcatatcccgtttaaaaatatttattatattcttcatattcaatgctcctgtcagcaaatatttctttgtatagattatatcacacaaaaatgaccaagagtcattttttcttcaataattattttccgtacttaaaacttgatttctattctggagaaattaactattatacatttacctattcaattaagatgaaatgtatgataaaaaaataaagaaaatgcccttagctattatgctaaaggctataaaattactaatagttaatcaattcttatttcttccttctatgtatgaaaaattaaaattagcaattaattttattaaaatttaaatgtagatatttttttaattaatttacttgtgctctctttagattcatttatatttaatattattttattagttttctcatttatttcgactaccttttctgctatttcagtagttccttctgctccatctgtggaagcttcagcaacttgatctattgtttttaaaatatcctgtatagatgccaaaagttcctctgaagttgagctaaagtccgaaactaaactactaacaaattctgcatccttgctatatttatctgcaacttccatcatagatttataatcattatctacgttatttgaaataaatttcaaaagcttacttgaattgcttgataaatcacctacagattctgtaactttatcagtaacgctctttatttcagtaactacattcttagattcttctgcaagttttcttacctcttctgcaacaactgcaaatccttttcctgcatcccctgctctagcagcttcaatagcagcattcaatgccaacaaatctgtttgtgcggcaatctcgattatagattcagataatatactaattctagctacaatatgagagttctcaatggctttttcaagaccttcttttgtctctaaaaatatcgcctttgctttttcttgtgactcaatcgtatttttcttaacatcatctgcacttttttgtattccttcaactgatattaatccatcttgaattttttccgatattccctctacagctttttcgatttcatgagatgttgctagcatctcctctgatgatgcagctgtttcttccattccagcagcaatactctctgtactgcttgaaacttcttctattgtacttgatagattatctatcttactatttatatcattatttatatttataacattttcagtactctcattgacctcactaattattaaccttaagtttgatataaatttatttaaactatttgcaagtccagcaatttcatccttagatttaactttaatttcttgagttaggtcaccacctttttctgcaagtgcatctaactcatcctttaaactttttagtgatgctattattcctttgataatcataaatgaaataactattgaaaaaataattaatactgaaataattattatagatatattctttactttttggtatatatcactaccctgcttagaaaaatccgctcccatttcttgattatacttagacaattcattcaatgattctgatgctgagtcgaagtatttctttccttctccattcatgatttccatggcctcatcagttcttaaatctctactcaagcctataactttctcatgtattttcaaatattgattccaatcatttttagctgtctcaaataattgcttatctttatcatcataaaatgttttttcatataaattcatactgctttgaatttcgttattctttgcttccatatctttttctttttgagccatttcatttttgtcagttgagattatatgttcatattctattattctaaaatcagatgtcatcgtgtttatattccctgattggattaatcctggaattaattctgtagacatattagctgaaaccatattaatcacatttaagttattaattgaatacaaacttaaaagaaccattgaaataataagcatagatataagtgatactaatttacctttaatcgatttaaacattaaaacccactccccctttaatcacataataaatatccaacaaatttatattatataaatacttattcgatggttttttacaaaaacctttttaatttcattaaaattttaattttcacttcattacaacaactatatttttatttccttaatttttattaaaacttttcaaatcccaactccactatttgtaattttagaaatttaattaatcatagtaatgagattataaacaattgtaagattttaaaacaaaaaatatttcatgtatcctaatacacatttttttcaaaaaaataacacatatttagctattttcataactaaatatgtgtcatatataaacccttcactaagtttctaaaatatgaaactcgacaaaattcataaaattttggtgcaggtgacgggacttgaacccgtacgtccatgtgaacactaccccctcaagatagcgtgtctgccattccaccacacctgcaaatataaattactcacttaatgataatctattcttatttaaaattcaagtaattttcataaaatatttaagttaatcattaggcagagactaataattaacttaaaaaatgtacatttaggaagcttttcattagatcaactaccttatctgcctcaaaataatcgtcttttttatcataaagatattgatatatatgataatatgtgtttaccttatcaacatatttttttgtttccccaaaaggtatataatctacactttttccatctgaagagtattttctattatcaagccatgattgtacattagttggtcctgcattgtacgctgcaattgtcaaatccatatctttatcaaaagtatcattcaaacgcctaaggtaccagcatcccattttaatattatattcttcattatacaggtcttctttagagaatgtattatatcccatttctttcgctgcccattgtccagtatcaaccgttatttgcataagacctacggcatttttatgtgaatgcgcatcatcatcaaatttactttcagtttttataactgctagtactagcaatggatctagattatactgcgaactgtacatatcaacatactgctggtacttataaggaaaaaacttttcttttataatatatctcgaacctatgccaattgctgctacaattactactaagaatactattgcacaaaaggtttttcttagaaacttcattatattctccttacttagcatattagttttataaaatcaataaaatcataaacttgcttctgcaattcaattaaatcagtattattgtcaataataatattcgcaaactcttttttttcttccatagacatttgagaatttattctactaacagtttcaactttagttaatttatctctattcataaccctttgaatttgaactgaattatccgcatatacaagtacaatataatccatttcctcatgcatattattttcaattaaagtaggagcatctattattactattttttcattcttttgttcgtacaattttatcttttcttcaattgattgtttaatatacggcataattatactttcatattttattctttgtttaggaaatctgaatatgtggtttccaaattctttccttctaaattcacctctccagtcaaagaaacctgctccaaattgtgcccgaaccatttctaatatctttggattattttcaagtacttctttagctatagaatctgcatctattatttttagtccttctttacttaaaatatttgatacagtgctttttccggtgccgattccacctgttaaaccaattttaaccattttataaaaaccaccttttttaattccacaatacattatttggcatcgtaccatgtatctccaaaattaacatccacatcaagtgctacttttaacttaattgcattttccatttcataagcaactaaatttttaacttcttcaaattcatctttttttacatttaaaataagttcatcgtgtacttgaaggattaattcactttttaattctttttcatttaatttattataaacattaaccatcgcaagctttattatatcagctgcacttccttgaattggtgcattcattgccaatctatcacccaaagccttaactattttatttgaagattttatctctggaataaatcttcttctatttaaaattgtcaatacatatcccttttctttagcttcatctacaacattttcaagatattcttttatcttaggatatctttctaaatatatagacatgtattcttctgcttctttctttgtgatctttaaatcttctgcaagactaaacgcacttatcccatacactatcccaaaattaactgcttttgctctacttctcataagagaagtaacctctcctatcggaactttaaatacttccgaagccgtttttgtgtgaatatcactatgatgctcaaatgcatctatcatattttcatctccagcaatatgagccaatacccttaattctatttgcgaatagtcacatgaaaccagtatatcagtttcttccattggtataaatacttttcttatttctctacccatttcatattttataggaatattttgcaaattaggttctgtgcttgatagtcttcctgttgtagttacagtttgattgaagtttgaatggatacgcccatcttcatcaaccacattttttaaaccttctacatatgtagaatttatctttgtgatttgcctataatacattattttaggtattatatcatgcttattcattagcttctctaaaacttcttggttagttgaatatccagtttttgttttcttaatgactggtaaatccaatttttcaaataatattttgcctaattgtttaggagaactaatattaaattcctcatccgctaattcatatatttctttttgtgtcttatcaatttcttttttaaacttcgtctgtagctcatctaacataccttgatttatgttaaatccaatactctccatggatgaaagcacataaattaatggatgctccacttcataataaagttgatccatattttccttatgaagattttcttttaatttttcataaaccataggtaagtaactgcaaagaattgccttaatattactgccttcactgttaggattatcaccaatataatgattaacaagttctagaatttcatatttactctttgatgaatcaattaaataagctgctatcgcagtatcaaaatcaaatccctttatttcaatttgatttttatttaaaaatgtaacaaagttttttccatcatgaataacttttttaacattatcatcttccataagatttttcaaaacttttaaagcttcttcactatccttagaacttatgtctttgaaatctataatagtacccttattttcttcccctaatattaaatattcaagttttaatttagaatatctagatgcatcagttaaagtataatctatataaattctatttctcatctccgaaaataattctttcatatcttcaattgtagtaatatttctcacttcaatgttagattcttcatgaactgtgtcatctttaaatttagatagtattgacttcatttcaagtttaatgagcatcttcttaatttctaatatattttctttattattagaacttatatcttctaaatttaattcgattggaacttctctcataattgtagctaatttcttagaaaatattgcttgttcaacattattttctaaattttccttaagttttttcccggaaattttatctatatttttaataactttttcaacagatccatattcctttataagcttaaaagcagtcttttctcccactcctggaacgcctggtatattatctgacttatctcccattaatccttttacatctataaattgctctggagtcacttcaaattcatccataaagctttctttatcataaacagcagtttcactgacacctttcttagtaattataattttagttttttctgatgctagttgaagtgcatcacgatctcctgtaactacaaatacttctgcattattgtcctcagcaaattttgacaccgttccaatcaaatcatctgcctcaaagccttcaacttcaaatatcttaattcccattaacttaaatagttctttaataatcgggaattgttccgcaagttctggcggcatcttattcctacctgctttatattcggaatactctttatgtctaaaagttggtgctttcaaatcaaaagtagcaattatactatctggattaatttcatccttcattttaagtagcatatttataaaaccataaatggcattagtatttattccatcactatttgtaagaggaggcaaagcataaaaagccctattcataagtgaatttgagtctaaaatcaataattttttcattaaaaacctcctgaaatttaacataaaaatttactcaactagaaatattattatctacttcaagtcattatttaaactcattatactatattgtataacttaaagtatacatgtatcttgttgtgtaatgaatttatctcatattatttccataattattagtaataattcttattttgtatattctttattttactatagtagataacttgcaaaaattgttataatgttaattatagatcgtaattccaaatgcaaagtattttaaattaaccagtactataaaaatctattatgtgatgaggtgatataattgttagataaccttttatctaaatatgctaaacttgctattatcaaaggtgtaaatatacaaaaagatggacttttagttataaatagccctattgagtgtagtaactttgcaagactacttgcagatgaagcctataaatatggtgcttctgatgtagttataaattataatgatgaaaaattcaataagatacgatttaataattcttcaaaggaaattctttctattacgccaaaatttgaaaaagataaatatgactattacgtagaaaacaatgcagcatttttgagtatttccgcgtctgatccagatatttttaaagatgtagattcggataaaatatcggcataccaaaaaggcagacgtgcagccttagagaaatatcatagtgcatgtacttccaacaaaaatgcttggtgcatagtttcaattccaactgaaaactgggcaaaaaaagtctttagtgaatctaactcatctgaagcaatcgaaaaattatgggatgcaatttttactgttatgagacttaaagaatccgatcctatagatgcatggaataagcacactaaacttcttcatgataaggtattagaattaaattcctataaatttaaatatcttcattttacaaattctcttggaactgatttaaaaataggattagttcaagatcatatttggtgcgggggtgaggatataacgcaagatggtctgagatttattgctaatatgcctacagaagaagtttatactacccctaaattggatgacgtaaacggaattgtttttagttcaaagcctttaagctattgtggaaatttaataaacaatttttcattaacatttaaaaatggtaaagttgtagcttgttctgctgaaactggattagatattttaactgagcttcttaatacagacgaaggttcaagatatctaggtgaggttgccttagttccatataattctccaatttcaaattcaaatataattttttataatacattatatgatgaaaatgcttcatgccatttagctcttggttcttcatatccttgctgcataaagaacggagaaaaaatgacaagagaagaatcaattctatctggttcaaatgtatcgttgatacatgttgattttatgataggaactaaagatacaaatataactggtattacaccagctggtgaagaaattaaaatttttaataatggtaattgggtttaatattttttaataaaataaaaatacaggattgattttacaaccctgtatttttattatttatttttaggcttgcttcgttctttattattagcatatgtcttcaattcattattgagagcctctacaatattattatactttgccttaaaggcgcgcctagccataaatctttgaatccataatgacatatatccaaaaaatttatctgttgactgttcttcttcaaatactaatttggttgtgccatctttttgccctttgaaattatatgtggatacacatgttgtaaaatcagttgaggtagtaatttgatatttttcattttttgcatagcctgttatttcaactgtacattctactggattaggtctaccagtatttatgctcttttgaatcttacatcctgtcgcatcttcttcgttaaaatccgaaaaatctttctttgcattttttataaaaatatggaacacatcttctactggataatttaatattccaatagctttcattttgaattccccctctaatgaatttactttattattttccagtaaaatattctatccctattgcttctcgaacttctctaagagtattagctgccacttctctagccttgttgctaccatcctttagcattttatataccgcatctatatctttttcaaactcaattcttctatttcttattggttccaattcagcttgtaaaatttcatttaaatatttttttacttttacatcaccaagaccaccacgcttataatgctctttcatttcttcaacagcatttttatcagttgcaaatacatctagataagtaaatacagtatttccttctacttgccctggatcttctactcttatatgattaggatctgtatacattgacattacttttttcttaattgtatcagcatcatcagatagatatatacaatttcctattgatttactcattttagcttttccatcagttccaggtaatcttcccgcattagaacttggaagtactgcttctggctcaactagaacttctccatatatagagttaaaacttctaacgatttcccttgtttgctcaatcataggcagttgatcttctccaactggtactgtgtctgctttaaatgctgtaatatcagccgcttgacttactggataaataagaaaacctgccggaatactattttcaaaatttttctgttttatttcttgcttaactgttggatttctttctaaccttgataaagtaacaagatttaagtaatgcattgttaattcatttagttctggtatttgtgattgtacaaatatatttgatttgcttggatcaattccaactgctaaataatcgagtgcaacttctgttaaactatttcttatcttttcaggatttcttgcattatctgttaaagcctgctgatccgcaatcattataaaactttcatataagcctgattcttgaagtacaactctattttttaaagaacctatatagtgtcctatatgtaatttacctgttggtctatctcctgttaatattactttcttacccattccaaattcactcctaaaccgcaaaactcattaaacttctgacttagttttactttcaactactttattaattacatctactcttttatctcctaagacattagctatcttaactgacatatttttttctttatatatagcttctctattagcatcaactatcttcataattctttcttccatcttttcatatgaaattaggtcatcataatatgtatccacaatgtcctttaaacatgttgctaattctcttggatttctataaactgctctcatttcttactccttaaatataacaaaataatttttatataatttatatcaattcaaaattctcatcccttatctgaaaattatgaactaaccgcatgtattaatataagctaaaataaattccaccttaaaattattatttaatataaatctttaacttaatgttccataaatacttatattataacaaataagtttcgctttattatatcattatacatagtaaaattctatattcaaaaataaagactaccttaaaatgcaatttttaagatagcctataaaattctaattttcaaacctactgattaacttgcttatttaatactaattgaaaaatcattaggcactatcattacaatacatttggcacgtttgacaacattagtagttactgagccaatcattcgatttaaacctcttttagtagatttagtcataacgattactcctatattttcttcatttgctttctttattatttcatctcctggatatccaaaagtaaaataagtttctgtcttataatctttcattttttctttagctgcttgtaatatttcttcacccaattcttgtgcaaattttatctcatcagcaactatcatttcatttatcagtactaattctttaacattcattattataatttcaattgaatctttatcgggaaatatttcttttacaaattctaaagaatgcatacttctttctgttccgtctattggtattaacactttccttttattcatgtatactccccttaaatatctcgatattatagtattctacacattagcaataatatcctctatttcaccttaatgaatatataattttttacttatctatataaattcccatttctaatttaagtataccctgaaataatcatttttataaatttatagggcatatctacatataaaactttttatatatgcaaatatacccttattttatttatatttttattcgataatttctccattagtagaaatagttactacttgccaaggaatcattttatcacttgcctttaatgcatttttcacagcattttctattccaccacaacatggaacttccattcttacaacagtaacactttttatatcattcatcttcaaaattgtcgttagtttttctgaataatctccctcatctagttttggacatcctattaatgtaattttgtttctaataaacttattatgaaaatctccatatgcataggctgtacaatctgctgctataagtaaattagcattattaaaatatgctgcattgggagaaacaagtttaatttgcacaggccattgattcaattgtgatactatctcaccctcagttctcgcatccttcacttcaatcttcttatggtttaacattctagcttgtgcacctgggcatccaaattgaattgtttgattcttgtttaactctaatttcttttgctcagtatttcttttctccatgtttatctttacagcttcttcatcataagcagctgcttctctctcttcgaaagaaatagcattagtttcacatgaaggaagacaatctccaagcccgtcacaataatcatcccttaataattttgcctttccatctactatacctatagctccttcatgacaggcacttgcacaaacaccacatccgttacatttctcttcatctattttaataactcttcttatcataaaattctcctcctacatttcatactcatttaaattcactaatcattaatttttgaccatacattaataattgaaatatagcatttaaataaatcaattaacttatagaattattataatagaatgttcatataaaatccgtttcatttgatacagaaatattaattatcaatttttaattttctaacaatgttaagttttttaaactgaagtccaatattttagctgagtgtgttaatgctcctacagatatgtaatcaacacctatttcagctatttctttaatattatttagttcaacatttcctgagaattctattaaggctctttttcctattatttcaactgcttctttagctatctctagactcatattgtcaagcattattatatctgcgcctgctaatagtgcttcctgtaccatttctaaattttcagtttctacctctatttttctaacaaatgaagaattttttctagttagctctatagccctttttattccaccagccgcactaatatgattgtctttaatcattataccatcagataaattaaatctatgattacatccacctccaatctttacagaatatttctctaatatccttaaatttggtgttgtttttcttgtatctaataattttgcatttgtgtgttttatttcttgtataaatctattcgttaatgtagctattccactcatcctttgaagtaaatttagagcaatcctttccccaactaataagcttctcgtattaccttttagaaaagcaactctgtcttttacatgtgcattatctccatcacgcttataaaattcgatctccacatttcctaataaatcaaatactcttttaaatacttcaaggcctgcaactatgccttcttccttgcaaattaattctactgtagagatactttcttctcctataattgaatttgtggttatgtcaccgcttggacaatcttcaataagtgcatcttttattattttatctataactaaataatttatcatctaactttccacccttttcttttatagttctaacagtcatctctttattttcttcttgtaattcatcccatgatttttctaatctctccacaggaaaaactttaatttccaaataatccacaatattgttaattgatattgcagctcttcttgaaaatacaagtccttcaagtaatgaattacttgcgagtctgttagcaccatgtactcctgtacagcttgtctctccaactgcatataagtttttcatagatgttttagaatccaaatctacttttattcctcccataaaaaaatgctgagctggagaaaccttaatacattcttttgttatatctgttcctctttttaagcattcctcataaatggttgaaaatctatttatgatataatcttttcccaaaaaccttatatctaaatttacataaggcacttctgtctcttttatctgattatatactgcttctgataccacatccctcggcaaaagctcatttatgaatctttccccttttatatttgtaagaattccaccttcccctcttagagattctgatatcaaaaatttcctcttattttcaccttcttcataaaatgctgtcggatgaatttgaatataatccatatcctttaattctataccgtgtcttattgctgatgctattccatctcctgtcaatattctctgattagttgaattattaaataatccacctatgcctccagttgccaatacaacagcttttgcataaacatttatttgctcatcttctcttattaacatggctccaatgcaattattttctttttctataatatctacaaaatgagtattttcataaacacttatattttctctctttttcactttatcaattaaaatttttgcagcactttctcctgtattatcctttgtatggactatcctatttacagaatgagcgccttcttttgtaaagtttaaacttccatcttcatttctatcaaaagcaattcccatttcaatcaatgattctacgttaaccatagattcattaattaaagtttcaacagcctccaaatcatttttgtatcttcctgcttttaaagtatcctctatatacagtggaatatcctcaacaccttttgcaacagatattccccttgtgccagataagtgttactacaagtaatcttatctttgcatacaatcaagacatttaaatctttccttaaatttaatccacaataaagacctgatacccctgaacctattattagaacatcaacaaacttattcatatttttcctaattacttctaacatcttgcgatgcaagtaaatgcatattttctaacgatcttaacgccttttttctaacattttcttctataatcatttcatttttcatatttaataaggcatcatacaaattttcaaaggttgtctttttcatgtcttggcaacatattttatctcctggtataaagaaatttttattaggattctttttctttaattcatgtaaaatcccttcttctgtcgctattataaaatcggttccttcatctttagtcgcataatctattattccacttgtactccctatataatctgcaatatctctgatttcctttgtgcattcaggatggactaatacttttgcatttatatgtttttctttttcaatcaatatatcttctctgcttaccttattatggcacctacaaaatccatcccataatatgaactctttttctgggaaaaactccgatatatattcacctagattcctatcaggtaaaaacataatctttttattaggtatcttctttaatattttcaatgcacttgaagaagtcacagctacatcacaatgagctttcacattacacgttgaatttatatagcaaactacatatgcatctggatgtttttcctttaattctaataaagccttgccgcttgccatatctgccatagaacatcctgcactaggacatggcattaaaacagtcttattcggtgataaaacttttgcactctctgccataaatttaaccccgcaaaacattataacttcctctttgcaatctctagctatttcacttaaataataagaatctcctacataatctgctaagtcttgtataattcctggttggtaatagtgtgcaagaataagtgcattcttttctctctttaactttaatatttcttttgctaaatccatcgccatgtttatttacacctcttttaattaattttacaggtgtatatacaccattgaaaataattataacaccacaatttttaatattcaacagatttcattgccttatttaacctacaaaaaatcattttatttttcttgacagctaaaagttatagttgtattattgtattaacaacttagtacaacaatacagtagtacaatttacgaaggagtgagactatgtcatgggattttaatgacgatagaccaatttacatgcagctaatggaacaaatacaacttagaatcgtttctggcatatacaaagctggtgaaaaattgccatcagttagagatatggcaggtgatgcagctgttaatcctaatacaatgcagaaagcattaacagaacttgagagaactggtttagtattttctcaaagaactagtggcagatttattacggaggacgttaatatgattaaaaatataagaaatggtttagcaagagatcaaattgaaaaatttcttcacaacatggaaaaaatcggttataccaatcaagagacaatccaacttatagaaattatatcaaaggagatgaaataatgggtaatgctgataataaaatattgtataactctagcgaaagtgatacaatgtctacttttacaaatagcaatatggataatgtccctattttagaatgcaaaaatttatttaagacttattctaatacagaggcattgaaagggataaatctaaaaattaatcgtggcagaattgttggacttttaggtccaaatggcagtggtaaaagcacactaataaagttggcaaatggtcttttaactccatcaaatggagaaatattaatatcaggaaataaacctggaattgaaacaaagaaaattgtttcatatcttccagaaaggacttatcttaatgactggatgaaagtttcagacattattagcttttttcaagacttctacgataatttcaatcctgagaaagcttacaatatgttatcaaaacttaacattaatcctaacgataaattaaaaactatgtcaaagggtacaaaagagaaagttcaacttattttagttatgagtagagaggccgatttatatttattagatgaacctatcgcaggtgttgatcctgctgccagagattatattttaaatacaataatcactaattacaatgaaaatgccactataattatatctactcaccttatttctgacattgaaagaatattagatgatgtagtatttatatcatatggaaatatattcttaactaaaagtgttgatgaaataagagaaaatgaaggcaagagtgttgatgctctatttagggaggtatttagatgttaggaaaattaatgaagtatgaggtaaaagcaactggcagaacccttataccgctatatttagtattattagcatttgctatcattaataaaatttttatcggaactggtctatcccataaacttcaaggatttggttcaatcccatttatactaagcatctttggatacggatgtactatggctgctgtattcatagtcacctttttcataattatccaaagattttataaaaatctgcttggtgatgaaggatatttaatgaacacccttccagtgagcaccatcacaaacattacaagcaaactttcaattgccactttttggactataataagtggaattatagccatactttcaataattattatggcatttgaccctagggcttttggtcaattcttttctgaaacttttagggctctttcagaaggttatgctaaaataggaatacaaatttatgtaattattatagaattattaattgctatgatatttcagtttgtaaaatttattagtatgatttatgcttctatatcaattgggcatatatttagtaagcatagaattctttcatctttcggggcatttataatattaaatttaattgcaggtgcaatatcctcatctattgggatagctttttcatcctctagactgcctgatttactaagaaatattgaatctctttggcctattaatttatttttaatatctatcacagtatttaatataatcttcataatagtttatttcataataacaagctatatattaaaaaataaattaaatttagaataaaaaatgctattttaaatatataatcttagtatagtgccaacttgtataaaaagctaaatacaaacactaatacttaccaagatagtatatttatttataaatattaaaaaagcgactattgaaataattttcgatagtcgcttttaatatgcaaattttttagtcattttctatgcatttttataaattgttaaatattttatattgacttattcctcattttattacataattacatataacttaataggtaaataactaagatagaggcgcgaaatttaagagtattattatggaggtaagctcattgaagtaataagaaaggaactttcgccgaagtaaatagctgattgctttaatactatttgctgggcttgtgtaaaatatatacaagactgccacaacttattttgtggagagctatttttaatgtaaatgtcgatattcgtcatatttttaaaatgtgtaactttcgtatttatgtcatgagtatgctctcatggctttttttattgttttaatttttatattatcttagttacttgcttatggaaatttaaaaccataatggaggatagaaaaatgagtgaagaaaatcacgaattaaagagaagtttaaaagcaagacacttaaacatgatagccataggcggatctattggtaccggtatattccttgcaatgggtgatactctccaccaagctggtcctggtggtgcattagtagcttatgcactagtaggtataatggtatactttttaatgacaagcttaggagaaatggcaactcatatgccaatatctggttcatttagctcatatgctaataaatttattgatccagctcttggatttgcccttggctggaactactggtacaactgggctataacaattgcagccgaaatggttgccggtgctctgttgatgaaatactggtttccagatgtaaatgccctatattggagtattttatttttagtaattatagtaggcttaaatattttatcatctagagcatatggagaatcagaatactggtttgctggtattaaggtggttaccgttcttatattcatagtaattggtgttttaatgattgtaggcataatgggtggagataaaataggatttcataacttcaccattgaagatggacccttccatggaggaattaaatcaatattttctattttcttaattgcaggtttttcatttcaaggtactgaacttattggaattgctgcaggtgaaagcgaagattctgagaagaatattccaaaagctataaaatcaatattttggagaatattaatattttacctaggtacgattattgtcctaggagcaataataccatttactgaagctggacttgatacaagcccatttacaatggtatttgaaaaagctggtattgcaggtgctgcttcactgattaatgcgatcatattaacttctgtattatctgctggtaactctggtatgtatgcatcaagtagaatgctttatgcaatggctaaagaaggtatggctcctaaagcttttgctaaaacaaataatagaggtgtacctataaatgccgtacttctaactacattaatagcttctgcttgctttttaacaggtctatatgcagagagtactgtttatgtttggctagttgcagcatctggtcttgctggatttatagcttgggtaggtatagcaatatgccactatagatttaggaaagcatatgtttatcaaggaagggatttaaatgagttaaaatatagggctagtttatatccatttggtccaatattagcattattaatgtgtattattataataataggtcaaggatattcatacattactcctgaggcgattgattggaatggattaattgcagcttatataggacttccattattcttaatcttatacgtaggttataaaataaagaataagactaaagttattcctttagataaagttgatttagacttctctgataaatagtaacaaaaagtaagatcataatttttaagtttaacttttacttgtactttctattttagctttaaatattatatttctctggaaataagaagagtacctcaaatatttttgaggtactctcctttctatattatatgatcctattcattaattatataaggcacagttacaataactacatttctcatcttaagtatagatcttcttaaaagtattgatgtttgattatgaagtgtctgatgccaccatttatgtataataaattgaggcattactattgttattacttcgtgtttctttaagtgcttatgtttttcttccacatacgctaaaagtttttcgttaacatttctgtatggcgcattttctatgaccaattgagctgctatcccaagcttattatacttttctattagtttctttgtgacttcttcatctgtactaacatgataaacttctatgttctccccaagagttaaagcgcaatttaaactcttaatgaaagatttattaattgtttgaactggcacaataacatgttttgttattgcttctcttacaattaaactctctaaacctgtttctatttttaagttctctctaactttagtatagtgtcttctaactcttaacattcctgttacaagtatcggtatgcatacaagcacaatccatgctccatgcttaaacttctctacacctattattatgcatgttgctgctgtaacagctgcccctaacccatttataaacgctttatgtctccaatgcccttccttgctcttagtccattttctaaacattccaaattgtgataatgtgaatgatataaatacaccaaccgcatataaagataacaacatatgagtactaccatctgcaatataaactaaaagtgaggatactagaaataacaatactattccatttgaaaaacttaatctagttccccttttcccaagttgtcttggaacatatccatccttagctaatattgataacagtagcggcaaatctgaaaatgcagtattagctgcaagtgtaagaataatagctgtcgtagcttgtactataaaaaacattaaactgttttgtccaaaaacttggatcgctatttgtgctattactgtaatatcttgacctggaactgctttgtacattgttgaaaggtatgatatcccaccaaatataataaaaacaatacaagctaatgttcctaatactattttcgcattcttctgagctggatttttaaaattaggtattccatcacttaccgcttcgatacctgtcaaagcagtacatcctgaagaaaaggcctttaggaataataacaaagttaaatctccagctgcttgtggaactacatataattgctctggactttctttcaacactaatactttgaatactcctgttattatcattattattattgataatataaataaatatgttggtattccaaataacttagatgaatcccttattcctctaagattccctaatgttattaaccctattacaaaaatagctattaacggttgatacggcaacaaggctggaatcgctgatgttattgcagctgctcctgcacaggtactaactgcaacagttaataaataatcaattattaatgatgacgctgccaccaatcctggaagcttacctatattttcgctcgcaacaatatacgatccgcccccatgaggaaaattatcgattatttgtctatatgaaaacactattattcctaataaaactgtaattgctattgctatttctatcatggatccatatgcacgcataccaagaataggtataagaactaatagtatttcttcacttgcataagctaccgatgaaatagcatcacttgataatattggcagcccccaaataacactaaatttttcttcagctaattcgttagttttaagagctcttccaatcaataatgattgaatttttttaaacataattcttcccccatattgtaaaaattattatgcaatttcaaatttatttaacaggtaataaaaaggattttctcctccttttttattacctgctattacaacatacagattatatatctatatattattgatgtaaatatatttatttttataaatacgttttcaatacaactttatttttaaatatttttcgacagtacgattttgtctttactacttactgtattttaaataaaaagaaagaagataactagtttcataccagctatcttcttctattatttatcttatattaatttatcttaagaacattgccatatcatcttcaacatttgtaattccacctataccaaagttttctactaaaacattagctacatttggtgaaaggaatgctggaagagttggtcctaagtgaatgttttttactcctaagtgtaatagagataataaaactattacagctttttgttcataccaagcaatgttaaatgctattggtaattcatttatatcttcaagaccaaatacttcttttaattttagtgcaattactgctaatgaatatgaatcattacattgtcctgcatctaaaactcttggaattccaccaatatctcctaaatctaatttgttatatttatattttgcacacccagctgttaagataacagtatcctttggaagcgctgcagcaaaatctgtgtagtatgatctagctttttgtctaccatcgcatcctgccataacaaagaatttcttaattgctccagtttttactgcatcaactactttatcagctaaagctaatacttggttatgagcaaatccaccaactatttctccttcttcaatttgagtaggtactgcacatctcttagcttgttcaataattacagagaaatctttctttccattttcatcagctgcaatatgagtgcatccttcataacctgctgatccagtagtatataatcttcctttgtaactatctcttggaggaactatacagtttgtagtcataagtattggtccattaaagctttcaaattcttctggttgtttccaccatgcatttccgtagttacctactaagtgtgagtatttctttaaatgtggatagtagtgagctgataacatttcagaatgtgtatacacatctattcctgttccttctgtttgaattaatagttgttctaagtcttttaagtcatgtcctgaaattaatattcctggatttgttccaactccaatatttacttttgttatttctggattaccataactttctgtattagctttatctaataacgccatcccatcaacaccaacttttcctgtttctaaagttaatgctatatattcatctattgttacgttgttattagcagttaatgataatgctttttgcataaatgcacatatattttcatcttcatatcctaaagcatttgcatgtttcatgtatgcagataaaccttttaatccataagtaataagttctcttaaacttctgatgtcttcattttcagtagctaatacaccaacagtctctgctttagcttccatttcttctcttgtttctgcattatataacgcagctgcacttaagctttctttgttagctaattttcctaataattcttcttttatttttaaagtatcttttactcttccataaaatacttctttatcaaagttagcattagttatagtagtgaaaagattcattgttactgtagtattaatagcttgtgatacaacgataccttcttctctagcttttgttgcaacttctgataaacctctagtcacgtatattaataaatcctgcattttagcaaggtctggagtcttaccacacacaccttttacagtacatcctgtacatcctgctgcttcttgacattgaaaacaaaacattttattatccatattgaaatctcctccacacacttaatttttatcaaataaatttttataaatttctatatcagttaggtacattccctcgaatcaccttatgaacctattttacattgaaattataaaatactctgtttcatttgttacgactcagaaatcttttggaattatttttataaatacataaaaataacctagaattcatatatactctaagtcatcacaatttaaaggtattgtgacgaacttaaagtgaagtggtaaccaaccgaaatagaatacatatatgtttcgcaggactagaaaaacttcgctgggtatgtctaaataggagtttgtatccatttatgcatgctccaaaattcattttggacaagcaaaacggaacaatatcccattaagacataccatcagctcatttttcaatgcctgctgcacatatatgtattctatttctttgttttactatcactttaagtatttcacagatttatcttcaaaagttatatatttgtgtattataagggtacaaactgtattagtgattgtaaataatctctatcaaaggtattactaatctgataaatataaaaatacttgcattaatatattcttaatttaaacttactactaaacaaagaatagtaatatatgtttttacagagtgttcataagaagattttgctggccgttattctagattataagttgttccaaatatgcttgttcaaaagcgtagtctttgaagcaagcattttggatgcaacttataatcttagaataatccagtaaaatcttctaggaaacagagtaaacacatatattcccattcgattgtctggcagtaaattaaaattatactatactgcaagtatttttatatttcagacgattcgcaatacatttaattctagcagaaatgtattccactccaataaatacgttctttgataatagttttttctgggaattctattccctctagagcccactttttatattcttcaaatccaactctatcaattatataaccaatatgctcttttccacctggagcatctttgtctatatattcctcaacaaatttataagtatttaatattattttaattatactttgctcatcagcccaaattaagaaatcttcagcaagacgagggttcttcttacctgatcttcccataagaactaacttataatatttttctttacttcttgtccatgccccagtaggacacgcatttgcacattcaccacaaccaatacatttttctttatttcttacgattttatagttaatggcttcaagtgctcctactgattttttcttacaagctttcacacatgccatgcagcttacacatctatcaatattatattgtggttctgtcattccaattatcccaaagtcatgtgttcttgctttaatacaatcattaggacatcctgttaatgcgattttaaaatgtaaatcatttgggaaaatagctttttctattttctttgcaaaattagttgtattataattagcaaacggacaaacattgtttccaacacatgccgatacatttctagttcctgcagcagtatatcctttgcctggtatttcttgatttatttctaatttttcaataattggttgtaacaattcatttactttatccatatcctcaaagcttatacctggtacttcaaaaccttgacgtgttgttatatgaacagttccatcaccatacttttgtgatatttcttgtatcattcctaataattccgcatctaaatgcccccaggaactctaattctagaggcagttatccctctttttttagtgactctaaaagcatttttcttgattgcctttgtatttaaatccacaactaacccctcctaatctattaagaatttgccttttgaataattgaaaacaggaccatctaaacaaatataagtatcatctattttacagtgtccacactttccgattccacaacacatttttctttcttgtgaaatccaaatattattttcatctataccacgttttaaaaactctgcaacagtaaacttcatcataataggaggtcctactacaataactgctgcattattaatattctttattagtaaatcaggaatatattttgttaccattccaacattgccattgtatccttcttctgcattatcaacagttagaataagatttatattacttttccacattttaatatcatctttgaataaaacgtcattaggagatttaaatcctgcaattagagtaaagctttctgcttcacctgcattttttgcaaagtaatctacaactcctcttactggagaaagacctgttcccctgcaacaactattaattcttttcctttgtaattttcaatatcaaagccattaccataaggtcctcttagaaataatttatcgccaacataattattaaatatttcattagttacttttccaacacgtcttatagttaagtctacagtaccgtcttcaataccacttactgaaataggcgcttcaccaaactttggtaatgaaacttcaaagaactgtcctggttttacatcaccattaaactccattcgaaaagtatattctatttctgtatgtttaattacttctttaatttccgataaaaaaggaatatattcatttttactcattgtctgccacctctttcataccatcttttaatttgttcacacagttagagaatgatatatattctgggcagatatcatcacatcttccacatcccacacacatatgatatccccatttctttttatagtcatatactttgtgtagtactttaaaacgcatacgttgccctttatctaacctaaaactatgtcctccagccatatttgtatatccatctacatggcaagatgcccatactcttcgtctttcacctgctttaccattatcagtatagaagacatcctgcattgtaaagcaagtacatgtaggacaaacaaaattacatcttccgcaagcaatacaacgagcactgtactctttccacatatctgatttcataacatctaaagaaagattatctagtatccaaacctttacactgttttccgttacaaagtctggtttaacatctaaagtttcatcaaccttaaatagctttcctaactcctcatctttagcatctacatatacattatctccatttacttttaagtatgcattatattcatcatttttatttgtttccatacttacacaaaaacaattttcaaatgagttttcacatcctattaaaataaattttgcattttctcttattctcttataataataatcttcttgtccatttcttaaataaatgtcatccatacgttttaccgcatgtaagtcacagcttcttaagaaaatgatagcaccttttttaggagcatctgcttcctttatggaatcttctgtgaaatagaaaagtgtttgagatataggaagtaatacttccttatatgaatattgggctttttgatcaaaaactatatcatctattgtttttatttcaccataacgtactctatcagtatcagagaaactaccttcaccttcaaataattttggtgcatatactacatattcttttgataaatattcgaatactttattaatatcatttttgcttaatttatatcccatcagcttactcctttacttcttttttgaaattatataataaggtagtgctagaaatactgctccaccaatcatatttccaagtgttactacacctatgttatacacataacccataatgcttacacttgcagctcccggattaagtaatcctattgtcaaaagagtcatattggcaacactatgttcaaaacctgctgttataaatgcaaataaacaccaaaatatcataataagcttagctgattcactttttaatttaaaactacaccatgtagctaagcagactagtatattacaaaaaatcccacgtactaataatggtaaaaatggtacactcattttagctgctgatgtttttgcaataaattctccaacgggtccagctgtaagtcctgtagcataaaataaatatcctgcaataatagaaccaactaaatttcctataaaacaaactatccatatgttaatagtgtctgtccacttcacttcttttcttaaagaagcagctgtcataataaagttgtttcctgtaaaaagttctgatcctgccataattactaaactaagggcaactccaaaggatactcccatgactatttttgtagcaggtgatccactaccacctaataatcctcctattgtgaatataagcataattcccatacccacataaagacctgcaagcattgaacttatgaaatatcctagtttatttgtctttaataaattaacttttgccttggctgccataattacactgttaaattcttcacaaaacatactataaattcccctttcatatatacgtttacctataaattaattataagttattaataaataaagcaccgtgatataaatcacggtgctttaaaaaattttgataatttatcttgatcaattactttgatttttttattctcatacttaattaatttattgtccaaaagtatttttagtgatctggatacagtttctctttttgagccaagtaaatctgctagatatgttacacttatattcatattaatagttactccatcctcacacttaactccataatctctgctaagtttccaaagttttgccgcaagtttcttttccattcttactacacctgttgcattctttagctgcctatacaatcttcttactttcatagctaatgagaacataacattcttggtaaggataaaatcatcctccataatctttaaaaatgtatatttatcataacttaatatgtaagactcttcaaatatctcacaatttatagacgacggtaaatcttgtataataacatcattaatcattttacctctacccaaaatgaatataacacgtttatttccattctcatttaatttatatagagatatacttccgcttaatactacatataaagtagatacttcttctttatctctaaaaagatgatttccaggctgatactttttaacttctccaaaatccttaagcttacttaaagatgatttagaaacactattaaaaatttctaactcctctaactgttcttcagaaatatttttcataaataactcctaattacttactataaacttaataaaataatatttgcgatagtaagctaacctaattattctattataataaaattattttatattaatgatttctacgtatacctctgccttatgaaatatcaatatatatcattttaatcaaataattctgcttctaactcttcaatatttaaaattttaattatatttctatcaaactcaatataatttagatctctaagattcattaattctcttgataaagatggtctaggaatacctagtgaagatgcaatttcttctttattttctttcagtttaactatttcacttttttggctctttgcctgttctaatatgtaatttataactttatgtttgatgcttttaaaagctatactttttatctttgaatttaacataaatatcttattactcaatgaagacataaagttccctaatactctttcatcacttgtacataattttagtatgtctgctctgcttatataaagtatattacagtcactaaaagctataactgtagatggatattttgatttctttgagaatactaatgcctcaccaaatacatctccattacttagtctctttagaattatttgttttccgctaaggtatattctttgaatttcgactatcccctctaaaacaaaacctaaactattacattcatcttcttcattagcaataatttctccctttttatatgatcttaaattatatccaatatttgaaataagatccctaatttcctcaacacttaaatcttgaaaaaattcattcccctttaatttattaagtacatcttccatatagaaattcctccaaaaaatatctaatcagggcccagacaaaatcagtcaaagttactctaaagattttaataattcatctaaatttctttttaattcaatagcactttcagttgttatgttagctttacatactatttgacgtggtacttctaatatgtcatcctttagaagtcttcctttttcagttaattcaataattactactctatcatcatttgtgtctctatatcttgttattaatcccattccttcaatcttctttaatagtggcgtcaatgtaccagaatctaagtgcaatcttcgtcctatatccttaaccgtactcttttcatcttcccataataccagcatcgcgatatattgtgtatatgttagattgaatttatccagaattggtttatataattttattatttcccttgatgctgcatataaagaaaagcaaacttgattgtctaattttatactttcatatttttttgatttattcataattcattctcctataaccgccatatcatttatataaatttaattttaacaaaccaaagtaagtttaacttttttgctttggcatgtcaattttaatatagcacttttcgtccaatacataaagctcacttatgctcaatattatagataacatatcttatttctataactttactattttttagaaacagaatccacataacttactgccgataaagctgctatattgccttctccagctgactttatatattgatatggctttccaacaatatcgccagctgcgaaacatcctttaatactcgttctcattaatctatctacctcaatatggttatcaactatctttaatcctggtaccaattgtcctggagaaatgctatctctaagtataaaaataccatctgtttcaatttctgaattctttagtttcagcttgcttactttatctcctcctataattccaactggtgtatcattgataatttctatagaaggatctacctcaactttttccttatacataggaatataatttactttagatgctattgatgcaataaaattagcctcttcttcctcatgcttattataagaaactattgtaactacctttcctctatatagtggagcatcacaagttgcacaatatcctactccttttccaagaagtctttcttctccatcaaataattttccgtattcaacacctgtggctaatattactgatgtagcttcatatattttttcatttaccattaaagcaaaatagtctcccatggcatatacattattaattctctcttcagttatatttatatccatttcttctaaatgtttattaaactcttcttgcaattctttaccgctttttttataaaaacctagataattatttatttcatgagcttttgcaagcttactagtaagttccttattcccaaatattataaaattcttttttcttattcttgcattcaatgcagctgacaaacctgcaggtccacttcctattattgctatatcatatctttcgctcatctttttttcctccatttacgtatatttaattataaacctatttctattataaactatcttatttaaactatataattataatatatcttctgcaccacttaatgtctatttcaaaaatgcaataatttaagcatttaacaaatttataatatcttctttaatttttgatggctttgttgttggagaatatcgccctataacttctccatctttattaactaaaaacttagtaaaattccattttatatccttattaaagagtcctctttttttatttttcaagaattcatatagcggatgtgcgctagttccatttacatcaattttctcaaacatggtaaaagtaactccataatttaatttgcaaaacgaatttatttcctcattgctagatggatcttgtttggcaaactgattgcatggaaaacctaatatttctaatccctgatctttatattccttataaatatcttctaactcttcaaattgtggtgtaaatccgcacttactcgcagtatttactattaaaactacttttcctttatattcttccatttttacttcttgaccattcattttatttgcagaaaaactataaaaattcatgattatctctccttacataattatgcttaaaaagtaacctttataaaatttaattttactcaacttatttatttaaaattaaaacatagtacattttaatattgcactatgttttttaatgtagaaaatattttatagattactttcaattgcttgttgaattttttcttttggtaaaaatcctataagttgctctgctttttgtccatctttgaatattatcattgttggaacgcttgaaatttgaaactcatttgctaagtctaaactttgatctatatcaactttaataaatttagcctttccttccatttcgcctgataatccttcaagcactggagataacattttacaaggtccacaccaagttgcaaagaaatctacaactgtaactccactctctatttcatttttaaattcgttagtatctactattttcatactttattcctccatcttataaattaaactaaagcttttttaaacatatctctagctattttaaacttttttatatttactattcataagaaaaattaaatttttataaattaaatttaactcaatcttttataatcatattgtactttttataatattcattgtcaatatttttattattatttaactatataaaaaatcagcttaaaatgcaaatatttctttgcgcgtaagctgatttatttgaaatacaagaattactctacatatcttacttcactataactttaaattcatcaaaatttatcttatactctgttagcatatctataacagtatccctaaaagaattttgtggagattttttttcaactggtttaattgatttcatagtcttattaatatttttattttttttatattgttttgtaagtacctcagctgttttaacaagtaagtcatcccaatcttcaacatctataatattatcatccaactttattgctttaggttcttttaatgaaaaatccttatatatttctatagcttcttcattaattaaggtattttttaattcttgtttttctttatctatagatgcttctttcttaatttccaccaaatcttttcttatcttacaaatactttcttcatcagattgtatatttttctcatattcatcttgcatccacttaacatattcatttatgttttcaacaacgctatatatagctatagatgtatctctataagctttacttaatttaaaatccctatcttttttaattatttcatttgacttatcttcaatgtggtctatggtattttctagtatgcttgccaagttgctcagaccactttgaatttcaatggacatggatggaaaatttttaattacatactgaatcgtatctacatcaaaaagagataaatttttctttttagaaattcttttatcaatctctaaattctcaattttagtttcattagttacttgaacttctttttcttgaatatcatcttttttaaaaaaacccattacttgacaaccccattcatatattatttatataaatattttaccatattattacatttatgttatcatttttaggatttttttatattatttttttatcttatatctctatattaattcctctctctttatatatggatttaaatatctgttctttttaattgtagactttcctatatttattgcttctttagggcatatatttatacaagccatacagtctgtgcattttcctaaccattttggtctattattttctatcacgatattatctaccgggcaaactttcttacacatattgcaactaatgcatttctcatttacattaaagtttctatctttatttctataaaaatctttccatatcttatatgctaaatttccaattccagctttaaagttaatttctttagcatctcttctcttaactgactctataaaatccactatcttactttcattttcttttatagtttcctcagctctagctttagtaggatttctacctgctcgcatataattagaaatatacctaatagtacaataattacttattttaacattactttttaataatttattaatttgaacaaagctagtatttgctccaccgcctcctgtaactccaattgcaaaaatatatgcatcttgatttacctttaactttgagataaattcattaacaacaatcggtagtcctgaacaatgaattggatatataaatccaataatatcttcacaaatatcaaacttattttcttttaacaccttactcatggatactaattcgcaatctttaaaactttcttttataatttttgctacatacaatgaattaccagtcgatgtattataaaatatcttcatttaaaattactcctctaacccctactatacctattattcatcaaataaaaatatatttatttgatgaataattccataaaaatttttcttatttattactaagatctataaattcttctatatcctcttctatagtttttaaagaatttctccagaattctgtatcatttatatctatgcccataactcttgctacatcagctattttattttttcctgtaattgaaagtaatttttcatactccttcgaaaaagtttttcctttttttaaatattcagcatataatccttttgcaaataataatccaaacgcataaggaaaattataataattatactcggcatcataataatgaggtttccaagtccacatgtatggatgtaaaaaatcaggatctaatccatctccatatgcttctctttgagcatccagcataagatcctttatttcctcaacacttaaagaacttccttttctagcttcgaaaaatgatttttcaaataggaatctagagtatatatcaacaataacttgtgtgcaatcgctaatttcagtttcaaggattgctaaagcttcattcttagaagcatcttttattgctgccttttttattattgtttcacaaaatgtagatgcggtttctgctatcggcattggataatctgaatttaacgtagtctcattatttaaacactctccgtgaaaaccatggcctaattcatgggcgagagttactacatctccaaaattatcaccatagtttaggagtattctactctctccattgaaatgtagattctcgcaaaaagctccacctacttttccttcttttggtttcacatctatccaatgattatcaattgctttccttgcaaaatctcctaagttgtcactaaatgttctgaagtttttttcaacaaatttagtaccttcttcatatgtaaacttcatatctgcttcgcaaacaggtgcatataaatcataaaatggtagtccgtttttatgacctaacatttcaccttttcttctcaagtatttcctaaataccggaagactttctttcatagctaaaaacattgcctctaaagactcttcactcattcttgaatctatgagtgtcttttcaagtggagatttatatcccctaaaatcacaaactgttaaaacttcaccctttattccatttaatgccgcagctacaccttcttctacttttttataagattttatttctgcttcatatgctttttttcttacagttgcatccttatcataggccatatttaaaaccattgttaatggtatatgcttaatttcattatcttcttcaatttctactaataatgtggaaatcaaattatccttaagtttcgcccaggcatttgagcctgtatttttcatattagcaattatactttcttccttatcgctgagcaaatattgactttgttcaactatattttttaacataaattcatgttccttaagtagcttagacttacttattatttcatccaggccttctatgctgctaatatatctttcaaatttaactgaactgccaattagatttgttaatttcttttctaaaatatctgaatacctcaatgcattcttatcctttgtatttacgcttaagcttagatttataaaaatactaattctactagataagtctgttacttttgtaaatctatttatatagtcctctaatttttctactaagttatttttatttttagtagcttctaatgcccatttattgatttcttcaataatatctgttaatttatttaagtcttgtttaaattcatcgccatcaaatgacggatatatttcctttaggctccaatttagttccataaatattcactccaagtctgtatttatattttttcctaactttattatataccattataatatcaattataggttataaaatattcattatataataaaaatctagaagttaactaataataaatttagtttaccttctagattcttacatatactatatgcgctttatattaaaattgttacatgcaaaattctaatttacaattacatttgcaatttccatctgtaaatttaattattgtatcctctccttgatgaataagtactccattatcaacattttctatattagaaagtttcttgagtactaaagaccattctccttctgtacccatagattcaataataatatttttttcatttttggtgacttccacttcaagaactttgttgcctttcatgtctacaacacttgtggcagttttcttattttctttcaattcataggccaaaattgatacattctctctataattatagtccggcttagaactttcatttccaacagcaattaaactattttctttaaccatcataggtacacttaagtaatcatgtctttctctgatccatcttccacccttatatttctttccgcttatgaagttagtccaaattccttctggtaaatagtaatttgcttctccttcttcattaaagataggtgcaactaagatagaatctccaagcatatattgtttatccaagtaattacaagctaaatcatcttggaattctaacatcatagctctcatagctggtacacctctttttgatacatcattagctatgttatataaatatggcattattctacacttaagtttagtaaaaaatctaaccacatcacaagcttcttcatcataaagccatggtactctatacgaactgcttccatgtaacctactatgagaagataataatccaaaagcaacccatctcttatatacatcagctgttgcagtactctcaaaacctcctatatcgtggctccagaatccaaagcccgacatacaaagagataatccacctcttaaactttctgccattgattcatagttcgcttcgcagtctcctccccaatgtactggaaattgttgtcctccaacagtagctgatcttgcaaatactgctgcctcatcgtctcctaaattttcttttaaagtctcaaataccaccttattatatatttgagtataataattgtgcattttatatggatctgatccatcgaaatattcaacctctgttggtatacgttcaccaaaatcagtcttaaagcagtctactcccatatcaattaattctttaagcttacctgaataccatttgcatgcatctggatttgtaaaatctacaattcccattgcaggctgccataaatcccattgccacacatcaccattaggtttctttatcaaatatccgtgttccatgccttcatcaaataactttgactcttgagcaatatatggatttatccagacacatatttttaatccttttttctttaatcttgtaagcattccctttggatctgggaatactctgctatcccattcaaaattacaccaattaaaatctttcatccaaaagcaatcgaaatgaaatactctaagtggcagatctctatctgccatgccatcaacaaaactattaaccgtttcttcatcataatttgtagtgaaagatgttgttaaccataatccaaatgaccatgctggtggaagtgctggtttacctgttagtgttgtataattttcaactacttctttcattgattctccaccaattataaagtaatctagacattctccaggaacgctaaattgaactttagtgactttttctgaaccaacttcaaaagataccctttcaggatgatttacaaatactccatatcctttattagtaatataaaatggtatgtttttatatgactgctctgtacttgttcctccatcttcattccatatatctatgctttgtccattctttactagaggggtaaacctttctccaagtccataaaccaattcccctactgataattgtaattcttccttcatgaagactccttcttctggaaccttcataaagactctttcttcagtagtattaacatatgctagtcctcttggcatactagacgttagctttttatcccctctataaaagctcatttgaaatacatctttatctattacagctttaagatctcctgatttaaatattatattattttcattttcttctattaaactattaaccttctcatatttataaatttcaaagtttggagacttttttcgttgtcccataaaatgatatgctctaactcttattacattttccattggcgaagagattttatatgttataactggcccctttaatgtatctcctcgttggtttatcttattacatggtgcataaagagttacaacatcatcttctattttagtactataaacttcttgagggctaaatatctgatatcctggcttgtccagccagcatccattgctaaatttcatattaatacacgctcctactctgtttcctaaataagcttttgtctttaggaactttataaattctattattttatttattcttcctatttaaactatgctaaattatctaactataacattcctgttcaattagccttttacagatcctgctgaaacgccgccaacaatatatttttgtcctaatataaatataattaatacaggtagcaatgttagtattatatctgcactaactaaattccatgaattttcaaatgctccgaagaaattataaacagctaatgtcatcggccattttgcagaattatttaaataatataaaggcattgtaaagtcattccaaacaaccataaaattcaaaacaaataaagttgaaataatgggttttaataatggaagtattatttttataaataatctaattggtccacatccatcaataacagctgcttcatcaatctctctaggtattgttgagataaatccatatgataaaaataggctaagaggaatgtttattgctgcataaacaagaataatacctaacctggtatttacaagatttaatgcttgcaaaactttcattaacgcaacgttgttaataggtatagctataccagaaaggataaagtaatatataaaattattaatacctttacgatttcttgcaataacaaaggctgctgctgctactacaattacaattattaaaacactacaagtagcatataaaaggctgtttaaaaacgatgagaccaattttccctgttcgattactgttttatagtttgcaaatacccattctttaggcagggaaagggacatcttattggattcaccttgagtcttaaaagaattaagaaataaaactaccattggtattagtactaataaacttataaaaattgttactatattggctgctacacttccaattgacttctttaaagtgaccattatgcatctacctccttattttccatggatttaataatgaaatatactaatagcaataatccaaagaataatatactcgataatgtagtacccattgcataatttcctttagaaaattccttatacactgctgtgttaattacccctgttgcattacctggccctccatttgttaatgaataaatcatatcaaatactctaaatccatatgttacatttaatattgttacatttataataattggttttaataatggcaaggttattaaacgaaacttttgccagaaactagcaccatcaatatttgccgcttcataataatcaggagaaatagacatcaatcctgcaataattacaaccattatgtaccccatacctttccaagtatctacagacatgacagttgcaaaaacaatttttaaatcagtcagccaattcatagccaagaaatccattcctacagatttaagaaaattatttacaaatcctgtatctggatgtagcatacttttgaaaacaagtcctactactaaataagacattacttgaggagaaaagataaccattctatgaaagttttttagtttgataaatttttgtgttaatagtagagctaaagctaggccaactacagttttcatgattgttgtaactgtagtaaataataccgtattccacaaatatgcacggtattccggtttccccttaaatacttcagcataatttttgaatcctataaaattgatcttgtccgtaaaattgttccaatctgtaaatgaataaaatatacctataattcctggtaaaaagcaaagtaagaaaaatattaatagagccccgcttgtaaagtaccacggatataatttttttctgtccatttaaatccctccattctaataaaataaggtttcaaaaggagaaaccttattttcatataaccgtaattatttatcccaatcaggatctttttgtaatttagcttgttctgttcttctattcataattgtttctaatacttgctttggagttgatgaaccactatacatagcctctaagtcttttccaatatccatccattggctgtcaatatatttaacgccagcttgcataaccattcctttttgcaatgaatcaatgtatgcttggtcctcttttgaatattttgattttacttcaggccagcataattctgataatcctggttgtccatccaaacgcttttgtaaattctcaggtcttgctaggaaatcaaagaatttctttgcttcttctacatgctttccatttttatttataaaatatgcattacttgcaggattcacaccaattgtttggttatctccccaaggcattgcaaatatacctaacttattaacgtcaaaatcagggaaatccgacttcacttcatttctccatgctgattctgctataaacattgcagcttttccttttgccatcgcttcttttgcattttctactgaattacttaagtaattatctccataaaaacctaaatcagcacattcttttaattcattgattatagtttgtaattcaggtatagaatctaaatcaacttcatttttattaagcttattatataagtctggatgcttttgttgatacattgctcctgtttcaaataatggaagtacttgatgccatccattttgagttccttcataaattggagtgactcctgaatcttttattttttgacatacatttttgaattcttgataattagttggtattttcaaacctaatttatcgaatatctctttattgtaaacatagaaatacatttttttacctggaaaagtgataccataaactttgctattgtatgagattgaaggaagaacatttgggtccattctctttacccattcttcacttgatacatctaatacatatttttcaggattaactcttgttactagatttaaaggatcggcatccgcgcagaaaatatctggagcctcacccgaatccaatttcactttaagtaaatcacgccattgagcatccggagaaatttgaaaatcaattttaattcctgtttctttttcaaaatcttttgccaaatcctgtacaactccagatgttggaagaccagattgatgagatccaaatgttaatgtaactgaatctccacttcccgatgcacttttacttccatctccactgctgcttccacaccctacaaaagcactccctatcagtactgtcatacaaaccgtactgactaattttaataaacgtttactcattaactatacccccattaatataaatatttggtgcatatttctgatatgctttacattggctacatgcttataatatcactaagtatattaattagacatagataaaaaagaactccgttttgcacttttttgaacattattatataatgtgttttggaaaggaggattataatgaattataaattacgttattctcaaaagacatacttattttctatttatgggttactagtagccttattattgcttttattctttctttgtttttattacttttatagtgataatatttaccaaacagccaaaaccaaatctgaaactatcagtgcctctattcataaatcagtatcaaccgaattaaataatatgtccacaatatccatgaatattgtctactcgaatgctataaaaaagaattttactagttttacacataataacacagatacaataaatctcgaacattttactcaatctagagaaaacgttttagctatatatgatattattactgctataatcggtccctttcaatcagccagtcaagttaatctttatacacaaaatggaatatgtataggatcaggtttctttcaaggagtaataaatgtagatttgaatactgtaccatggtataaggatacattagataaaaatggtgaaaaaaatatttttcttactgataaattatcatactctcctactaaaattgaaaatatgtcaaaccatcattatctttcactttcacgtgtattctttaatcgaaataatgaaccagaaggtattgttgaagtagtacaagattgcaacactgtattctctctaatttcagaattaaagcaaaaaaatccttcaacatcattctatatatataatgaacataatgagttagtttacccctattcatctgccccagaagataatataaattatactaatactatacaagaacacaatttaagtccatcagttgggtattttattaatatagatagtaagcatgatgtcctgatgtcgtatcaaaaagtcgattcatataattggacaatcattgccgttgaacctaaggaagttgttttcagatcattgcactcctttaaagaaggttttattattatagctataatttcaatcatttttacactatttttatgttttataatttcaagtagattaactcaacctttaagtactttaactaattctacaaagatggtcactatagacagagtattaaatgaaaatgaaactctattagttccaattaatagtaatatacttgaaatttccgagctctatcaatcgttttgtgatatgtatgaaaaattaagagattcttctcatgaaattttattattaaaatcagaagaaactcgtgcaaaactacaagcgacccaatctcttattaatccacactttttatataatagtttaacaaatataagtatcatggctgaagaagatatgaatagcgaaataattaatatatgtcatgcattgtgtgattatttccgttatattacaacatgcgatgaaactgctgttcatttatctttagaaatatcatatacggaaaaatatattgaatgtatgaaaatgcgatatggaagtgattttatttatacttcaaatattcatgaatcaacaaagaacattttaattcctaaactaataatacaacctatagtagaaaatgcttttaaatatggctttagctcctcaccaccttggattttagatatcaaatcttctataacaaatgatcaaaagtggcttatatatatcgaagataatggtggttgtttaagtgatcaagataaagagaaattattatctaatctctataatttaaacagaactaaagaactaaaatcattaagaattggcggaatgggacttaaaaatgtatatctaagattacaacttttatatggtactgaagctatattttcaattgataattctcaaaaaaatagaacaatttttataatcggtgggcccatacatctaaataaggaggatttttatgaacaatacacacacctataaacttattgttgttgaagatgaacatcttataagacagaatataataaaaaaaattaattctttatctattccttttgaattagtaggtgaagctagcaatggagaaattgccattcctctcatagaacagcaatgtccatctctagttattactgatataagaatgcctcaatacgatggattagaattaattaaatatctctacaaaaatcatcctcatataaagactatggtattaagtggatacaatgattttaaatatgctcagactgcattaaaatatggtgtaaaagattttttattaaaaccagtaaaaatagaagaacttagcactgctttacaaagcattcttgttatgcttgagtccgaaagtaaagaattctcttcattttcaattgatcaccacagtctaaagcctgaaagcctaagccagttacttgaaaattacttgcttaataactatgcctctgtgacatcaataaccgaaatttctgagaaatttggatttacaagtgaatatataagtaagatttttaagaaatataccggagtaactccgataaaatatatcactagaattcgcattaatgaagccaaacagcttttaattaatcagcctgacttggaaataaaaaaggttggtgaattgattggttataaagatgccttctattttagcagagtatttaaatctaatgtaggtgtgtatcctagcgactatagaataaaacatttaaattataactaataattctatattgttctcataatattgtgttttacaccatattaattactatcatgaatttatcactccaaagaaaaatagaaggcaaactctcatattgactgtttgccttctgcctcttaagtaactaaccaaaaacttttaatctatcaaaactttttcttagaactaagctgaataattattttctttattaactaaatgactcctaactttcaaatgcttgagataagtcataaattatatcatcaatatgttctgttcctattgaaagacggattgtatttggtttaattcctgactctgctagttcagtttcattcatttgagaatgtgttgtactcgctgggtgaattactaatgatttaacatcagctacatttgcaagtagtgagaatatttgtagtttatcaataaattcctgtgcttcctttgctccacctttaatttcgaatgtgaatatagaacctgctcccttaggaaaatattttttatataaagcattatcagcgctctctggtagcgatggatgattaacactttcaacccttggatgactctttaaaaattctacaacttttaaagcattctcaacatgacgttcaactctaagtgaaagagtttctaaaccttgtaataatataaatgcattaaatggacttatgcatgcacccgtatctcttaataaaatagcacgaattcttgtcacatatgcggcagccccaactgcttctgcgaacttaattccatgataacttggatctgcttctgataattgtgggaactttcctgaacctatccagtcaaactttcctgagtccacaataactccacctagtgatgtaccatgtccaccaataaatttagttgccgaatgaacaactatatctgccccatgttcaatcggtctaaataagtatggtgttccaaatgtattgtccactattagtggtattttatgcttatgtgcaatttctgctaatgctttaacatctaaaatatttgagttcggatttccaagtgattcaattaaaattgctttagtattatcttgaattgcattttcaaaatttgataggtcagatggatctacaaatgttgttgtaacaccgtttgtaggaaacgtatgtgctaacaaattataagatcctccatatatagttttttctgcaactatgtgatcaccagctttagttatattttgcaatgcatatgttattgctgctgctccagatgctaccgcaagagctgccactccgccttccaaagctgcaacacgtttttcaaaaacatcttgtgttgaatttgttaaacgaccatatatatttccagcatcagctaatccaaatcttgctgctgcatgtgcagaatttttaaatacatatgaagttgtttggtaaattggtactgctctagaatctgttgctgaatcaggttgttcttgccctacatgaagttgaagtgtttcaaattttaattttctttcttgattactcataatttgttgcccccattttatataatttttatttttaatatatttactatgatttgtacgttaccctaattttctagatattatatttagatttgaatttgatttttatcacgaccctagagaaatatacaaataattagacatttagataataaaagagctactttctagataagaaagtagcaaaaaaatatgtacattcttatctttcagataaaatatctgcaggaattagcaccttaaattaaaataggtttttaattcaggttgctaggcatcatagggccagtccctccgcctttcttgataaaaattattatattatattattcttagttgtttactatgatataaagtatacattttattgctatatatgtcaacagtattttaaattttgcatgtattttttatcaattagttattttatctagaattcacagtcatatattctaaataaacccagtcgcaatatttcttttctactttacaaatatttaatcttgatagataataattattataaaagacatggaggtaataaaatggaaagtttaactttagaagaaggaatgaaagctcctgattttacattagtaggatctgataaaaaagaacataaattaagtgattatttaaataaaaaagtcatcttgtacttttaccctaaagacaatactcctgggtgttcgcaagaagcacaagattttaaaaatgctttagatgattttgaaatcaaaaatgctgttattttaggtataagtagagattctctagcgtctcatgataaatttattgcaaaatatgaattgcccttcattcttctttcagatgaaaaagaagaggtatgtaatctctacggcgtattaaaggaaaaaaatatgtttgggaagaaatccatagggattgaaagaagtacattcgtaatagatgaaaatgggattatatcaaagatttataggaaagttaaagttacaggacatatagaacacttaaaatgttctatacaataatttaattatttaaaatattttatgataataaataaaaaaagatagttattacaactatcttttttgcttacctcgcaacgtcctactctcccacacagtctcccatgcagtaccatcggcgctatagaccttaactttcctgttcggaatgggaaggagtgttacctctatgccatcattacgagatattagcttttcccaaatctctgatttggttgaaaaacttatgcaaatcgttttagcgatttgtattccttatgaaagttttgttctttcaaaattgcacacagtttctttaatgtatttacaacttgactatattggtcaagccctcgacctattagtatcagtcagctaaatatgttaccatacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctccacttgtaggtgtcgcagtcaggctcccttctgcctttacactcttcgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccaccaaggctgacgccctagtttcccagtctcccacctatcctgtacagacaataccgaaattcaatgctaagctacagtaaagctctacggggtctttccgtccaatcgcgggtagcgagcatcttcactcgcactacaacttcgccggatttgcagttgagacagtgcacaagtcattacgccattcgtgcgggtcagaacttacctgacaaggaatttcgctaccttaggaccgttatagttacggccgccgtttactggggcttaagttcacaccttcgcgttaccactaagtgttccccttaaccttccagcaccgggcaggcgtcagcccctatacatcagctttcgctttagcagagacctgtgtttttgttaaacagttgcttgtgcctattctctgcggcctgatttctcaggcaccccttctcccgaagttacggggtcaatttgcctagttccttaactgcaattcttccgtcggccttaggattctctcctcatctacctgtgtcggtttgcggtacgggcactacttctctttctagatgcttttcttggaagcatggaatcagatacttcggttccgtgaaccttccccatcacgcctcagaattgttggaacggatttgccaatcccaactccctaaacgcttagactagcatccaatagctagcacatcctatccttctccgtcacaccatcgataataacgattatagtggtattggaatatcaaccaattgtccatcgactacgcctttcggcctcgccttaggtcccgactaaccctgagaagacaaactttactcaggaaaccttagatattcggcctgtaggattctcgcctacatctcgctactaatgccaacattctcactcgtaatcagtccaccgctccttacggtacgacttcagcccgattacgacgctcctctaccgctcacgttaaacgtgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccggactgatagtatgtggcattcggagtttgataaggttcggtaagcgctatgccccctagcctattcagtgctctacctccactactcacattttccgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctctgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgattatcatagttttcacttacgggactattacccctatggtccaactttccagttgtgttcaattaactatgatttctcgttatgttctgtccgcaaccccagagataaatctctggtttgggctctttccttttcgctcgccgctactaagaaaatcgatttttcttttcttcctccaggtacttagatgtttcagttccctgggtataccttcataaagctatgtattcactttatgatacatggggtttcccatgtgagtttcctcattcggaaatcttcggatctctgactatgtgcgtctacccgaagcttatcgcagcttatcgcgtccttcatcggctcctgatgccaaggcattcaccatgcgccctttgtagcttgacctaattattagtcatatcacaaagaatatttattcttggctttgttgtattttatatacattaaatctatgtgcaattttcaaagaacatttaagacttaattatatttaattaaatcttcatgtgagattaaggattcgaaccttgacccctgcgtgcaagcagtgctctccaactgagctaaacccatatttacgaaagacttagtctttcaaaattgaacagaataaatacttaagtaacctttgagcaagtatttaatatttatacatactatgatgtatttgtactagtcagacatcatgctgatctagatttctccatagaaaggaggtgatccagccgcaggttctcctacggctaccttgttacgacttcaccccaatcgctgaccctaccttaggtcgctgcctcgcttacgcgttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagactggttttaaagtttggctccacctcgcggtttagcatctctctgtaccagccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccccgaagggcttccccgattaagggtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaagtcgccttcgccactggtattcttcctaatctctacgcatttcaccgctacactagaattctactttcctctcctgcactctagatatccagtttggaatgcagcacccaggttaagcccgagtatttcacatcccacttaaatatccacctacgctccctttacgcccagtaaatccggacaacgcttgccacctacgtattaccgcggctgctggcacgtagttagccgtggcttcctcctcaggtaccgtcattatcgtccctgaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcggattactcctttaattgctatgccatgcggcactacaatcttatgcggtattaatcttcctttcgaaaggctattcccctctatgaggcaggttacccacgtgttactcacccgtccgccgctaatccactcccgaaggagcttcatcgctcgacttgcatgtgttaagcacgccgccagcgttcgtcctgagccaggatcaaactctcaataaaaagtttaatcttagcttactcaaataaaaattgctggtttacttaaatgtatttatcttattctgttcaattttcaaagaccaattttctttcttacaactttcgttataattttatattattttttgtcaccctcaagcgactttttcattttatcacttgattttcaacttgtcaacattttttttaaaatttcaaattcctttatttaaaagttctttaatatttctttcaaattgtttaccgctcttagcgacgtcttttatcttaccattaatatttatctacatatactcaatcatctgcaatatgcagcttttatattccaaattctctctttatatatataatactacaatatcctactatagatacacctggtatagttatccaatgcattatatttagattcttcatatttcttaatcatattaacttcttacactttaaaaatttgcttagactcactatcaatttatttgcccaatggcttaatttttcacataaaatatctggcttaaagtaaaacttagttccactccaagccagatatcaattttaccttatggtaatttgtttcctgctgctagatatatttcataccattcttgtctagtcaatgtgatatttgatgctttacatatttcttttattcgttcagcattcatagatccaactattgtttgtatctttgctggatgccttaatatccatgcagttgcaattgcagtattagttactgcgtacttttctgctattgcattaatcttcttatttaattctgggaatttgtcattatctaagaatacgccttcaaagaatccatattgataaggagaccatgcttgaatagttatatctttaagacggcaatattctaatactcccccatctctatctatagaagcatcatttttgatattcatgtttaatcctgcatctatcattcctgtatgcattatactaaattgcaattgatttataattattttgttattcaaatatttgttaagtaattctatttgcattggagtatggttactcactccaaaatattttactttcccgctttcgtgtaatttagaaaaagcttctgcaacttcttcaggttccataagcgtatctggacggtgtagcagtaatgtatctacataatctgtttttaatctctttaaactagcatctactgaatttaagatatgttcttttgaaaaatcatacattattcctggtactatagaacacttagtctgaatgatcattttttctcttatggaagaatccattttaattgcatctgcaaaaacttcttctgattttcctcccccatatatatcagcatgatcaaagaaattaattccttcttctaacgacgtcttgatgatcttttccgcctcgctcttttcaactgatgccattcgcatgcatccaagtccaatttcagaagctttgatttcgctattcccaatatttatattcttcatctttatacccttccttcttcaaatctaatatctatttaaaattttgaataaaatatctactatatccctctattgtaatttctccttatatctttccttctgcaatagattgttcgtgctgactaatccaattatatgcatcttctttatcccttgttaaaagtaagtataagatttctataacaaccatagccgatactctagaaaagctaaactcatctagaaatagtttctctcttgttgaagtatttatatgatatttgcttttgttggcaacaggagaattctcatgattagttatagaaatagttgttgcctgtctttcattagcaatttcaagtaaagctacaagctcttttgaagctcctgaattagatatcactataactacatcttctttagttaaagtatatgaaaatgcaagttgtgtttcccatatggtattagtaacagatgatattcccaactggttaaacttatatgctccatccattgctacaggtattgtattaccaaccgctgcaaattgaacaattctcgctcctttaattgcttctaatattctttttatattaccttcattcatcattgaaattgtttgtttcaattcttcaattttatttgctaatatattttgaagtgattgcattatattattggaatctaattcatttgatatattactactttttaaattaaccatttctttagctattttaattttcaaatcataaaaaccttttaaatcacattttttacagaacctaactattgtagcttcactaacactactttctaatgctaactcagaaacagtcatttcaatgactctttctttattattaattatataatcagcaatctttttttctgcttcatgtaagcttttataaatgcaaagaattttatctagaacactcttttctatctctctcactttaataattactcccttaatcatcgtattcaagtaattaattcataaaacttcttactcaaaagtatagcttaaattccattgtttccttacctcatccattatatccatgacatcaacagacaatcttaaagtatcattacctgttttactcattaccatactatttacgcattcaatttcatattctaatgcttttgaaccatggccttcttcaataatttctacacttccatcaggatatgtaattgttgctttatctgctcttggaaaattttcaacagttatatatcctaattctccacatacaattcctctctttggctgttttgctctcatagttaatgatataactgccatttcatcatcagaatttttaagaattatacctgactgctcatccactccagtttcgaatttcttaactgtagttaaaatttcctctggctgactagagagaaagtaccttgtaaatgacaatgcatatgttcctatatcaagaagggcacctcctgctaaatctgggctaaaaaatctatttgtcacatcatactctttaaggcttccaaagttaacttgaatcattttaatctttccaagcttgccatcatcaacaattttacgtaactttttatataacggcatatgataaatagtcattgcttctgccactattaattttttctcatttgctaattcaactatttctttcaattgctttccatttacagtaattgctttttcacaaaatacgtttttattattattaagactcttaattatatattcataatgattacagtgaggcgtcgctatataaacgacatctatattatcatcttttagcatctcatcataatctccgtaagctttttctatgttatatttattagcaaaatcccttgccttttcaatatttcttgaacctaccgcatatatcttcccattcacttcatttatggcctttgcaaaatctgctgcaattgttcctggccctagtactgcccaatttattttattcatatccttcacctcatacgttttaattttaaatttcattcttaattaaattatttttgtgaaatttccctaataccttccttactagcaataatcacttttgtgattacattagtaaataatgacgtttctataactccacaaattcttattagattatcatttagtttatgaatatcttttacattattaaagaatacatctactaataggttgccattatcacttatagtaaatccatcttttatatcgctacttctaatcactggtttcccatttaattctagtacttttttttcaacatacttcaaagaatcctctaaaacttcaagtactaccggaacattaaatgttaactctttttcaacttttgcctcatcaacaagaaggatatattcttccgccatactagcaattaacttttccttagtatgaattcctccaccacttttcaatgcatttaatttttcatcaacttggtcacagccatcaaaagcaacgtccactttatccacagaacttgtgtacaaaacttctaaacctttttctatacaaagcatctttgttttcactgaaggagtaactatctttacgttaatatttttgtcctgttttataaattctattaaataagctatgctccgccctccacctagacctactatcatcccatcttttatatatttcatggcttccttagcactatttttctttaaatcgttatcactcattctcaatatcctcctaaatacagtatcaagttaatataatcataatatgatatatttatttcgtcaatattattattcatgaaataaattttcacagcagaatatcatttattataggctttactaaatgcaaaaaatgatgctttaaaatagtgtaaatcacttcaaagcatcattctaatatgtttaaatatactttttatatcttctaagtaccttagcaataggcaatccaagcaataatccaataacaatctgagtcacatttccaggtattgatgcaactggtgatgcccagtttccataaagtattccttcagtaatgtagtatccgattatcatccaaatacctgataagataattgctaaaagattaagtatgatactattaccttcttcatttctactccacgctatggcaccaaccatatatcccataattcctcttactataaatgtaaatggagcccaaagcgcccatcctgatgataaatcaaatattgccattcctacagcagcagctatagcacccttctcttttccaaaaacaattgctgtaacaaataacattacagttcctaaatgaaccaatccgccagtagctaatatcggcaatctaatatttataaacgctgttgcaacaaatactagcgctgtcaatagtgctgtttctaccatgtcttttgttttaaatttgctttttcttctgtttatttccattccttgccccacctttgcttaatttaataattaattatttaagtgtctaataaatgaatttactaattcaccattactttcaaagcctagatcttttagtccgttctcaattatatttaatgcataaagaatcttatcaacttttgcattctcccccatgtgtcctattcttaaaattatatcttcgtatggatttagtgatgttataattaaagtattgtatttactcaacatatgatttttaagcctctgagctcctatgttttccggtattttgactgctgttactgtatttgaataaccatcttctaaaaataattcaagtccaaattcactaacagccttcctagtcgcatatgctattttttcatgtcttttaagtacattttgaattccttcgtccaaaatattatcaaccgctttatctaaccccatgatatcacttattggcattgtgtacggaaaccacttatttgcgtaataattttcccagatattaagattacagtaaaaccctattactggagtctttctatttttcattgcttctttagctttttcgctgatgcttaccatagttaatcccgctggagctgaaaatgctttctgagatccacctaatgctatatcaatcttccaatcatcaacccttatttcttctccacccattgcagaaacagaatcaacaacagttaaaattccatactcatttaataatgggcatatcttagataaatcatttaaaactcctgttggcgtatcgcaatgaactattgttgcatacttaaaatcatgatccacacttaaaaattcatttaacttactttcatctatagctttgttataatcgcacgaaaaatataccccttctcctccgtacatttcaacaaagtccttaaaacctctcccataaattccattgtctaaaacaagtactctatcacctggttcagtaagagatgcacatgccgcttctaatcctaaaataccttccccacttagtatatataccggattttttgtctcaattattttccctattttatcacaagtatttttatagaattccacaaattcttcgtctacgtctggattagtagttatcctagctctttctaaccttacattctctctaacatttgtcggacccggagcataaacaaatttctcattcatagaatacatcaccttcctttcttctgtattttaatattaattaaaatatcatatataataaaaaaagtaaattgtacggatacaatatcttttttattttaattctctattaaaatgtaactttctaaatcgatcattttcataaaattaagccttaaaagggcatagcatccataaattctctaatgataacctactacaaaataaaaaataagctttcaaaaacaacttgaaagcttatttaatagaatttataaaattttttatgaattcttagatttattttgcatttatttcttctgtgttaatttcaatgcaaaatccaatactttttgaccattcatcattccataatcaaccattggtattacatctactggaattcctagtggctcacaaattttctttgcctttcctaatgtatatccaacttgtggtcctaacaaagcaacatttacgccatctagatttttatccatttgactttctggaaaagcttcaatatctacttctatacctttagtcttggctgcatccttcattttattaactaaaagacttgttgacattcctgctgcacaaaataatctaatttttatcatattaattcctcctaaacaatgtatttattctagtgttattacttagttaaagtatttacaaattttcttaatttaattatttaatcaattaaactattttttgttattaaataatcctggctatgttcaaataaaactctattataggaaaaccattaaatattaatttttcctttttattgatcggtatgaatttattatataacaataaattttctttgtaaatgttttccgatatatccagctaggataagattttcttcaataggatagttgtgactcatcttttatataaatttaatcatttagaaccgccactaatagcaaactatcggagtaccttcttcaatattattaaataagacctttgctaggtaatatggtgcattaacgcatccatgagaaccgttcgctttgtatatgtttccaccaaactctgatctccagcttgcatcatgtataccaacattcccataaaaaggcatccagaaagaaacagagctactataattttcacctttcaaggtagcatccttttgcttataatttaatcgataaactccagttggagtcggagagcctctgcttgcattacctgtaacaacatcaccttctattacaagtattccatttttgtaataccataagtgttgaatattcatattaatttccacataagtattgcctatgtcattactatcatgagataaagcaacttgcttatatataggctcttttgctatattctctcctttcccaatatctttaatcaactcttttgcttcctgtgaagtatcaattacccatccataatttcctccactaacttttgttattgttcctaaagatgttttgaaatctcttgtttttcctgaggtattatacgtattagcaatttttttcatatactcatagacttttttttcatcaattgcaacagaataatcttgatctactttaagccaattgtgtattactgatccatcaataacttcattatcttcgccgaaggaatatgtaatttttgatgatgcatatttatcgagtatatttttagcttctaaaacttccttagatgttgatatatacttaggattctcatagcaattaattgattctaaattaattttcttctccccactaacaattgcctttattaagtgttcatacaaagcatctttattaatcttatttccatatatctctttgttaattatatatccatcatctttatattctaattcaggatttttaggtgccactacactgcttcctgttatacaagaaagattattaaagcttttctttaataaatcttcgttatatgatacagaatccgtaattgtataattcttctctcctaaaaaagataaaatccaagcaaatgaaatctgcttacttttcagttctttaattttgtctcctaaatcatatcttaagttaatatcccctccttttatttcttcccttgcaccataacgttcttctaattccactgaatatgtgtccattttagataatatttcttcttctgcctcttgcactgttttacctgagacgtcaactctgttaattgttgaaccaaaataaaaatgattgataaaatgtatagaaactattgaatatatagctaccagggcacaaataatcatcattattctttttggatattttatgtattgtaatatttgtttaatcatacttatcccacctgacatcattcaaccttacaattttcatttttaaatcctaaaattatagcttgtacagaaaatatattaagtaacttttattgaagttttatattttaataattatgtaattataattgtatttagaacattttaaattgaatttattaattataaaatgtttattattatttataaaaaaaggaaagttctgacctaaaaagatcaaaactttcctttgcattaattataattaaatagagctttttactctcgtgtgttgattagaaatatctctaatattactcatgaacaataacagggcagcctgggctaatattatcaaatattgcctttgccacataatatggtaggtttacacatccatgtgaaccatccgtcttatatatttcccctccaaattcatctctccaactagcatcatgaagaccaatatcattcttaataaaaggcatccaaaagctaactggtgctgcataatcttcacctcttaatactgaatctctttgcttcgaatttaagtaaaacacgcctgttggtgttccatgcccagtactttcattacctgtaactaggtcaccttctacaacaagatatccatctttatagaaccataaatgttgtttacctttatcaacttcaacaaaagtatcaccaacattactaaaataactggatatagatgtttgagtatatattggatatttacttatagtttgtccattctttatattatctatgagagcttttgtttcttcagaagcattaatcatccaactatggttattaccattatctccaccgctaacctttacgcttgtaccaagtgatgatgcataagtatttgctatattgtctacatagtttctaaccatattttcatcaattgtcacattaaaattactatcaacgccaatccaattctttattgttgaactatctaaatattgtgttaatcccccaaaattataagtaattttagaagccaaatacctattaagtgtatctctagcgataacaactgctggagaatttattttgaatctaggttctgaactttcgtaacagttagcagcttctaaattcaatgttgtatccccattttggatagcttttactatgcttttatataatatatatttgtttattttgtttccataaacttcttttgatattacataattattatttactaagactaaagtagcatttccagattgaaccactttactatcatcagaacaacttagtttatttatagaatcctgtaacaatttattatcaaatgtgatacctgaatcagttttcaaaccaatgtcatgtccattaatttgttcctgaactcctcctctttcctgtaatattaatgcatatgtttcaggtaacttttgtttttcatttgtagtttcagcatatgcacctatactattaataagagaaataaaaaatacaatgctcagacaatagaaaaaggttatcatctctttagcaattttattagatctattttgtttttcttccataaaaacccccttatataagattctattaatattaaatttttgcacatacaagaaatttttatataaatattgtaaagcttctatatacattattccccctttaaacgctctttgtaaaatataaaatctcttgaataatataacatgttattaacaattgtacattacatattatacaatattttccatataataatcaattgtcatataatatttctcttaagttaattacatacttatgttaaataacaaaatctcagttgcttgtatgatcagaaattttcttaatcagctgcatttctaagtgtatgtaagaaaaatttccaagtaaatatattttctattttactccatttatacaactttccattattaatcagtctttttcatattttatctgcaaacttaaattcatataaaataaaaaggtatgaatttttcacccatacctttaactatccaattagattaattttagtagatctaaaatttacttattctagttgtgcttggcataatgataaacactttaaatatgcattttctaaacacctaatagtttgtctattgtatcaacaagatcacttacttctggcttacttagctgtgcatttgctcccactgattctcccttatgttttaattctcccgtaattagtgatgaaaatattacaacaggaagctttttcaatgtttcattttcttttatttttcttgtcaatgtgagcccatccatctgaggcatttctatatctgtaataagtaattgagcttcttcaataaatttttcacctttatttcttgctaattcttcgaagaaatctaacgcttgtttaccgtcatcaaaaattcttaaattcttaaatcctgcttttgtaagagtatcttttaataaccttctaattaaagcagaatcatcagccataactaattttatagatgatctatctttataatctacttgtataagtctatcttcacttattccaacacttggacaaatatctgtcactattttttcaaaatcaagcataattaatacttttccatttaaaagtatatttccaacagctaatgagttttctgatagatcatcaggttttcttatttcatcccatcttatacgatgaactccaactatatcatcaatattaaatgaaacttttattttattaaactcacaaactataaccttggatccaagttttcctgccgatctttttgttaatatgtattttaaatcaatcaaagtaagtatctcatctctgcatagtatgaggccagctatctctggcttaggatctggcaatttagttaagtttgaaggcatctctattacctctttaacttttacaacattaattgcataatgatttccatttgcgataaattctattatttctaattccccagtacccgattctagtaatatgttattattcataatatctctcccccttacttaagatcttgtaattgtagcattattttgaaaaatatatcctttcactttttttatagttatcatagcattgatcctatgttttatatcgtattcataattatagcttatgtatatgttgaataaacatattattctatttatgcctatacttttattaaatacttacatctattatcgttgccatatataacttctttaattatatcatttatacatgataatttgtaattaaaaaaactaaaattcatactcactgtgaaagatacataaaactgttttaccttaaaatgataaaacagaaaacattatttttttatctttgtctcatttgcagaagcctatctttcaatttaccttcaatttcttgtaattcagcttcagcagctttacgtttttctcttccttcaatttgtattcgtaaaacttcatcaagagttgatatcaacgattcatttgtattctttaaagtctcaatatcaacaattccacgctcagattctttagctgtctcaattgttgacatctttagtgtttctgcattcttacgtaacagctcattggtcatgttcgtaacttcattttgaaccttggctgcattgtttgaatgagctactccaagagctaatacaatttgactcttccatagtggaatagtattaacaagagtagattgtattttttctgacattaatgaatcattattttgaacgagacgaatttgaggtgccatttggagtgaaatcattctagttaattctaaatcatgtatctttttgtcaaagcgattgcaaagagccacaaaatcatttgtcgcctgagcatcttctggaagtccacttatccttgctctttctgctaacttaggcagctcatccttttctaattttgaaagcttctttttcccagctaatatgtacatagaaagttctttaaaatataccttatttatttcatacattttatcaagcatagcaatatctttcaaaagctgtatttgatgattttctagagcactacaaattttattaatattcccttcaaccttttcatactttgctttcatttgcgaaatcttttctgcagatttcttaaaaagacctagaaatccttttttttcttctacagattcaaaatttttaagctcacacactacatttgttaacatttccccgacttcgcctaaatcttttgttttaacgttatttaatgctgtctcagaaaaatctgcaatcttcttttgagctcctactccatattgaagaattgaatttgtattatttatatctattttatctacaaattcattaatcatcttcttctcatcttctgttaaatagctttcatcaaaaatttctttcttcttactttcttctacctttacatcagtaacttcctcttcaaaaggttcaaatgttaaacttggcatcatatctatatcttccttaaatccatcattcacttttaattcctccttttagttcaagtcctattttttgaaatcatcttttttaagcccttcttgagtaaatagtgtttcaagaacagaaatatctgtagaaatatctaatgctatttcttcaaataaatcgtctaataacttttcaaatgcattatttatggtatccaaagtcttttcaatttcattttttgcatttcttatattatcaccctgaaccggctgctcattcaattctttatatgcattaagaagctttaaagtcataggcagatagtgttttgcaaatctatcaacttcttgaagctttttaggattctgctcaacatacttaagtatttgatttataatattctggagcctatttaattttttagaaatttcttctttatctatagaactacttatgtctcctatttgtttaatgtaatcccttcccatttcaattgtattccttagttccatcttcactggatcattgaagtctttttttagctcctcttgtttttttaattcatcttcattccttttcttcaaagattcctgtgaagtcaaataattctcataaactttattatttaacatgaaataagtctgcttatcatcaatatgtccttgtggaaacatatttaattcaatcatttttcttaaatctttaactacaaatttattttttttcctaacagcctcagctaattcactaatggagcaatagctattacctcgtagcaatttcacatattctttaaaacgcttcgctctctttcttaaatttataccccttaaagtaaaagctccactcgccgcaagaaaagaaaacaatattcctaagctaatcaaattactcattaaaaattcactcttaaaagaaataagtattgaatatgaaattattaatattcctaatattccgcttaatatagatccaaatattgtatacaatgttcctgatatacttccaactggtctcttagcaatatatttctgtattttattttcagattttggaacaacattcgcgatatttttatatctattttttaattcatcttttatctttttatcaaaatactgtgatttatctacaaatttatttcttgtctctctaacagtttcttgagctttatcatcaatatctttttttatcttagcaaaatctatgacatcgaatgcattttttattgtatctctaatttgattttctaaattagaaaaatcttttttatccattcccctgcctccaaattattttattaaaacttaacttaacattaatttatttgcaacgatatattggctttattatatcttattcttgtatccattacaatttgtaacatctttatctccctttaaaattctcattctaagacataaatatccataatttttttattttgatttttatagaaatgtaaaatctgcttcgtagactatgtatttctaatacctttaaaaattgttctcagatttcattataattttccccaaaataaaaaaatcgcaggcgctagaatataaattcctaaagaataaaataagccccgcgataaattatcgtggagctctagtttcaataaaacgcaaccttaaatttttataattccattaaaattatattatatatattctaatcctctaactcatctgagaatactctttcaatgtgcattgcaaggtatcctatctcaactgattttatttttttcttcaattccttacctagtttcatacatatgtcttcagcaatttcaaatgattttggaaatctttcactaatataatcattcatatcaagctttatcgtttctccttttaacattcttgccgccatatatttaatgtggttcataagacgattataggataatgattcgatatctattgtctttcctgtactctcttcaatggatgtaatacatgatctaactaacattgctacttgcattgcttgtgatactttttcatttcctaggcttgaatgaatatgaagtgctatatagccaatctcatcttcatttatttcaatgccttctatctctttgataatatcttttcctttacatgcaacttcatattcttctggaaataaagctttgatgtcttgtgttaatggattactaatttgttcattatctcttattctttttactgcaaatgcaatatgatctgcaagtgggcataaaatgttctcgtctacttcatgaaatttcttttctgcttccataataatattattcgcaatttctaaaatctgaggctctatattgtttattatctccttagtcaatcctctttcagtttcttgctgcaagagatatatatgtgcattttctggagcttcaatacgttcattgacctttttaccaaaacctataccttttccgagcaagatatactctttatagttatccatatttatagcgagtacaccattatgatttagtgcttttatcactctaaacattttatgcctcctcatcccttatatattattcaaatgcatcaactgcaattaaagcttctccggcttttatatctccagtttttaatagacgcaccttttgattgctattcaatgcagtgcatatgcatggtgatgcaatagatggtgcattattttttataaattctaagtcaaagcttaatattttatctccagcttgtactttatctccctcttccacataagtttcaaaggcttttttatcaagctttactgtatctattcctatatgaataagtaattcaagtccatcagttgttgttaatcccaatgcatgttttgatgggaatacaaaacttattactccatctgccggagctataacatttccatcgcttgggacaaccacagctccatctcccattatcctgctcgcaaatacttcatctggtacttcggataaatcttttgcttcacctgtcaatggactatttaaaatcactgtacttataacttttccttgaacctttttttcaatacctttttcagtatctttctctgattctttttttattattgcataaccagtatcttctttatctggtgctgtaactaagtaatcttctaaatttgattttataacagttactcttggcccatacattatttggacgcctacgcctttgtgaaatatgcccgatgctccagtttgttttaacaaaccttcattcaccaattcagagttatgtacagtacaacgcaatctagttacacagcaatcaacatcagaaatattgttctttcctccgagacctctgcatatcatggccgaaagttcgtctgcgttttcattttgatcatttttctttgcttctaaatcacttctagtataaagcttaacttcaccagaatcttcacgacctggagtctttaaatcaagcttcttaattaagaaggtgaataataaatagtatactacaaaatatacgattcctacaataacaatcagtatccagcttgttttagcatttccttgtaaaataccaaataagaataaatcaataaatccacctgagaaggtcatacctacgccaacacctaacatatgcattaacatataagcaagtccagcaagcacacagtgaattccatataatactggtgctacaaatagaaatgtgaattcaattggttctgttataccagtgagcattgacgttaatgctgctgatagtaataatccacctactgcttttctcttttctggcttagcacatttatacattgctagtgctgctcctggcaagccaaatatcataagcggaaatttacccgacataaatcttgttgcagaaacactaaagtgtgttattcctggcgttcctagttctgcaaaaaaaatattttgagcaccttcaataactttgtctcctacttgagctgtacctccaactgctgtttgccagaatggtaaataaaatacgtgatgaagcccaaacggtattagtagccgttccatcaaaccataaacccacgttcctgcataacttgatgcaagcactatatttccaactttgtaaatagcaccttgaactggaggccaaatataaaacattaaaattccaactattaaatagacaattgaacatataataggaacaaatctagttccaccaaaaaacgataatacttgtggtaattcaattttataatacctattatgcaatgctgctgtaccaagccctacgataatcccaccgaaaacacccatttgtaatgaaattataccaagtacttcagttgatgcgccacttaaaagagcttctgttccaccatgaattttaatcatggcaccaattgatgcatgcattataagaaatgcaattcctgctgctaacgctgcaacttctctttctttcttagacatgcctattgcaacccctattgcaaatattaaaggcaaattttcaaacacaatatttcctgcatcattcattactgaaagaagtgcattgacaaatgtgccaggtccaattaaacctgtaattccatacgtatcaagcattgttttattagtgaatgactcacctatacctaaaaataaacctgctactggtaaaatagcaattggaagcataaaagatcttcctacacgttgcaaaacgccaaaaactttgtctttcataattcttctccttcataggattatttttgcacattattaatgctttattatgccttttttgtgcaaaaaaacattaaccaacataaacatcttcaataaatatttatgtatagttaatgcctacctaccagtcacatactatatcatatttttcactctagcatatctataactgcatgtcaatgttttcataaaatattatcgcgggcattttaataaaagaataaacggtattagtgatttaacttttcttcatatatattatataatattctcataatatattttaggaggtcggctttcttatgaataatattctaactgaagaaaatataaaaaagttaagagaagaattagattataggatgacagttaaaagagctgaaatagcaaaagaaaaattagtagctgctgctcacggagatagatcggaaaatgctgaatataaagaggcttgcagaaactatagagaaaatgataatagaatccagtatctattaactatgatttcaactgcaacggtaatagatgatggtagtatagataaatcagtactaggaattaatagcaaagctagaattaggtttgtcgaagatgatgatgaggttgttgtaacactagtaacaactatggatctcgatcctgaaaatatgattataagtattgaatcagacttaggtaaagcattatctggaaataaagctggtgacattgttgaagtcaatgctccaggtgaaaaatattcagttgaaatactcgaagtactataatacctattagatattagttttaaatattcatatgatgcatattttgaatcccctagctaaattggtgattaatcaaaatctttgctaaaatataatcatataatagaaaatagtgcatataacaaagaagctttttctttgttatatgcactatttttactgatataattatgcaaatttatattttctatttctttgtataattcttttctttaagtaaaagattaattttttcaaggcgtttagtatataaatcataatcatctagcaaaattcccatataaagcatatccacaatagctaactgcgatatgcgtgaaaccattgtctcactataaaatgtagtttcttcaccaccagtaaaaaatgttatgtctgcatattcagaaatagctggtgctttaaaatttgttaatgcaatagttcttgctccagactcttttgctatttttaaagcatttacagtatctattgtgcttcctgaatgggatacaccaatggcaaggtcattacttgttagatgacttgcacagatttgctgtatattactatcagagtatgctctgcattctaatcctatacgtaaaaatttatttctaatatcactagcaacacttcccgaattccccacaccgtaaacatcaatgatatttgagcttctaatcatttctattgcctttttatatttattaatatcaattatttttaaagtatcttccaaagcctttatagtaagtccaatcatttttactggcacatcttctattttttcatctctatcaatatgaagttctactagtaatttggaatcatactgcttatctacagattcccttccccactctttcattaatgccatcttaaattcactatatccactacaacctatacttttcacaaaacgtataattgttggctcactcacccctacttgacgagaaagctctgctaaagtcattgtagaaacagaatgcccgtttaataatacataatcggctacttttttttcagatgatctcagtaaattatacatattttttattttatattcgtaagactcagtatggttcaattcatccacatcctttgttttgcagttttccttaaatatatattacactaatgtagtaaaactaccaattcaatatttctttaatactattctaagataattctcttatattgtaaatagttttactacattatatcaattgacattgtagtaaaactacattataatatattcaaaaggaggaatacctaaataatattcaatactgcataattactacattagaatattaaatactaaataggtgttatcgaaaattatgataccaacaaaaaaagctgccgaaatgactatagaggaattaggatcttacattgatcaatcagtgctaaagccagaatttactttagatcaaattagaaagtatattcaaaaaggtgtagattataaatgcaaaacagtttgtgtctatccatcctcaataaatattgctaaagagttaacagctgaaactcaaactgggatatgtgttgtatgtgattttccttttggtacatcagcaacatcctcaaaaattttacaagcagaagaatgctgcaagcaaggaattgatgagcttgatatagttgcaaattgtggctggacacgaagtaatttgtggcactcagttgaggctgatataaaagctgtcgttgatgtgtgtcatgattatgatattcttgtaaatgcaatttttgaaactgatgctctaacattagatcaaataaaaaaatctacagaagtcgctatttcagctggtgttgattttattaagacatcaactaattttctaacaggatttgctagcaaaggtgctacccctgaaaccataaaaataataatggatactgcaaaggatcgctgtaaaattaaggcctcaggtgccataaagacaagagagcactttctaaaattgattgatatgggaattgatagaattgggataggatataaatctactcctgttgtcttaggtctttcataatgaaaataataaatagctcggttattattgaaactaaagctataactcatcatagaaatatatataaaataggaatgtaatgaataatttatatacatattaatccatcacattcctagtttatattttaaaactaaattatctagatttctggttgtcattaattatagggatttttacctctatttttaccaagctcactcttctgcaattttaattgatttactggaattaaaaactcaaaatcacttattatcaacttcttttacatattgccatgttaacccttcatcttttgattcatacaaagccttgcatcccccattataatctccatcagatccttgacctattaaaacattaaggattccgtcttgctcataaggcatatctggcaaatcaaaaggattatatttttccccattatctagtgttacttttctctctggaaaacttacttttttataagatacaccgccatcctcggtgcgatataattctccgttactgccaccactatgagataaacataaaaaaccaagtttatcattcaaaaaacttattccagctgccacccctgttttccctgcaaaaggatcttcatttacaattgtccatgtatttccaccattaattgtgctcttcaaagagtacgatctgcttccagctgcagctccagtcacttctagcctataaccaacttgatcagacatataaaattcatcctgattatttgatttttgagaaatacttttatctttgtcttcttttaaaggtgtatgcgtcttaatgttatttaaatcttctgttaaaatatatctatacggagtatatattttttctttaccaggtacgaatactgaaacagcataacctattatctctgaagaggcctttgaagctgcttttgtgctcccttctggattaatataagtaattccatcagtattatatccaaaacttcggttaccgtaataaagaatcccatatttattttcattccatttgctcactgtatccttaagtgggatagctttcattgtacttagcaatggctctaacaatttatcttcattataatcagcatttgcatacccatttaaatatattgttattttatctgatttgtcattattataacttattaaataactttctaacttacccttattatcttttccataaagatatgtatcaaaagacgtaattgctccatcggaattaaaattaagattaaagttacttgaaacatacaatttatctggcatatgaatttctttattaatgtctgcgaaaataccttctattccattttcatatatattgttatgttcaagcttcactgtctttttgttttttaaatcacttaaaaaccacgaaagttttccgttatagcttattgtatcattatatatttttgctccgtaaaataatgttgtagcagctataactatcatagctatatagatccatatagttttataatttgatttaaaaatctttccatcattcaagctcttctttattatgactatttcttcatctgttctatctatcatacttaaaactaatatgtctctgtttctaagtgttataacagcatatttcctatttattctaaatgactttatatcttgaaaatctatctctagttcgtcttcttgtaaaacttttatattgctttcattaaatttatatttttctataatctgttgcggaacacttataggcttttttacactttttattattacatatgtaagccacactaaaaggaatattatacacccaaacaatataataatattattatgaaatcttccaaacctagaaagcgtatatagctcataaatcgaaatacaatatataaatacaaatattgggttagatatcattgataaaaatatacttctttttataatttgcctgtattttttcattttaacctccttgtataatctagttgtaacatttgatagaaaactatttatctttctaacgaacattacacctcttattatttttaatattctaatttattactttgcctacgccccgatagggaatatgcatttcatatcttaaatagttttttatttaaattccttaaaggaatctaaccaagttttatatagtctagtataatactcctgaatagaagatagatgtaaacctcctgggaggtcttttagaacctatacccgtaaaaaagcgtatcatttcatcaggtagaattctatgtttagctggttgggtttcccttcgggaattacccgtgtcacaaacaaggttataagctatctgacagagtggaagttctattctatatctaaaatttaatttaaggagatatatacaatgtctaatttttttatagtcctgtaataggaattgatgtttcagctgatttttcatatactgcaatactcgcaccgaatggtgatatttataagaagtcatttaaaataaagcatgatctcaatggcttcaaccacttagttaatgaaataaaaaaagtggaagaagagtttaacatgaaaactgcaattttcatggagtccactggcgtgtaccatttatctcttttccactatcttaataaatatttcgataacacatttgttatcaatccactcgttactaagtctaacaaaaatggcgacataagaaaagtgaaaaatgataaaaaagacgctttatctattgcaacaataggaaaatttcaaaacattaagttatcacaacaacttagccttgatatttttcttctgaaaaatcttgtaagagagtattacaaacttacagatactagctctacttttaagaaaaaattatccgctgatttaagagttatttttcctggctataatactatattttcagattcaacatctaaaagttcaattgagcttttaagtcaatatccaacgccacaatcaattttagaggcacctaaggaaaatataattaagattttccttgatagctctaaaaagggcattatctggtcggaaaatacatattccaaattatttaaggttgctaatgaagctaaaataattggcttaccgttagacggtttagccgtcaaaatagccagctctataacattaataaaaactattcaatcagagattgatatattgttacagaaaattaacaattttatacagtctgaaacttttcctgaatctattagagctaatattgaactaattgattcaattcctggcatagggcaattaactgctattactataatagctgaaataggtgatattgatggttttcttaagcccaaacatcttgtagctttctttggtattgatagctcagttaatcaatcaggtaattttaaaggcgatgataataaaatttcaaaaagaggaactcgaatcggtcgaagagcattatattctgttgcactagcttcaatccgtaacaatcgtaatggagttcctataaataaagtcctattagattattatcaaataaaccttaaaggcaaaaagcctaaaatcgccttagtcgctataatgcataaaattataaactacatttttgctgttctccgaaatcaaactccgtttgagcaaagagatcccaaaatacataagcaaatgttcctagaaaataactctttaaacaaagtcgcttaattttattccaatttctgtaaccgttcgtgttttgaaacggtttgtttgccatactctttttccaaaaactattttttttaaaattaacttgactattattagctggtcttgcttttttactagtatatataaattatacagcaaatttccaattatttgtattgttctgttctttatatctaatttgcaactgaaatatttcatacaaaatctagtgattatttagatttttatgggcattatcacccattcccgcctttcctgttatgctaggaccaccattcattccttgatttatcttaaatccatctgcaggattaatgtttatattttgagctgtgattgcttgacacgaaatcaatactactgaccaaataaacaataacataattatgactatactatatattactttcttcatatctctacaacccctttctaattgataacatatatttaataaaacttcttcttgaaacaaattcatacacatctttaaatcccatgtatgataaaattattaatatagggtatgttggataaatgtatctagattttatttcccataaaacataaaatccaataaatcctaaaaacactaaaactaagagcacttcgtcaaatttcttttcctttattacacctatcattcttatgaatataaaacaatacataagaaaattcattacgtacaaaatccaaagtaatccacttctatagaccgaatctcctttaaatagttcagtcgcaaaagtattatagctatatactttttcttctcttccaactctctgagatgagctaactgcttcattaccaatgccaaaggtttcaatttggtatgtcccttctgtccaagtccatataatcttgtcataatacatttttgataaactagtgaaacccatatttgataatttatttttaatttcttctttaaataactctgtacttttttctttattatatcttgcctgtctttgatatatattgtaacttttcatattatcccaataacctatcgtatcttcattcatccccatattaatccacatatatatgggtgcagaatttttattaacagattcattcacaatatttgtttcctgcaaaatgaaattttgattccaattgggaatattaaatagcactcctaatatgcagaatgatgttattgcctttttaactccagtcttctttacttgcagtaaaatataaaaaacagcagctattaaaacaatagttcctacgcttctaaaataatttcctattgataaacacactgaagcaattacaatatatttaattgatccatccttcacaaatcttatcaaaaaatatatagagcttgtaagcaatgttgtagctataatatcgttatatatataattactcataaataaagatggtatataggttgatgcaaatatcaaaactccataatcattatctcttgatttataatttatctctttatatatgtaataaatgattagactcgtaactagggtaaataaaatgttgaaaattttaagaactaaatagttattgggaaatatagttaataaagttttcaaatacaatacagttgaaaaattaaaaggaaacatatataaatatccgctactttgaaatgacgaataatcattcctatacaacatatttaaagctaatgatagtactgtttgagaatcagctgtcggtaatttagtaaataaaaatataattatcatttgaataataaaactaaataccaaagttactggaattactattttcttgctatatctgttaagttttaagcacattctatataaatctacacttaataaaactaaaattaatatcatgaatataaaaataccaagtttttgattttgaagaactggcttatctccatataaaaaagtattatactttgccctaacaaaaaatgatgatgctataaaaagtcctataaaaaaagtaaatattaaatatattatctttttaattaacgctgacatatgaaaactcctttattacaaatctattatttaatcatggaaatgcaacttgtccataacaatactgatcaaataaaaatacatttataaattttattataataaagttttctgtaagttagcttaacaatttcaaattttataaaaataatataattcattctttatattgagttatattataaatatctaactctaaaactaaatttatgtggtaacttaccaaaatcataaatattttgttccgaaaagctatgaaaatatatttatgatttctagtgaagatacgaacttaaaatactagaaaacttgcaaatatattcatctaataaatataactggtattatatcattaacataaaaaaaattaaaaatgaccaatgattcatatttaagaatcattgatcatttttattatacacctattaataatgctcttttactttttactttgcgcttatactcatacatacgtctatcagatctctttattaattcatcaaattcaattccttctcttgggaagttagcaataccatagctataactacaaacaattttgtttccttcaaatactagtgggcagtctttaaactttctaatcagttcttcaagcttgttagttaaacttactaaatctgaattcaaaaagattcctacaaattcatctccaccaaatcttcctataatatcgccctctccggccaaagcatttaagccttttgaaaattccttaattaattcgtccccagccaagtggccatagttatcattaacaagttttaaatcatttaagtcaaaaactacaaggaaaaattcttctatattcttatcttcattataaatttcactgtgaattaattgttcaaaccacgttctgttacatacattagttaatttatcatatctagataaatatagagttctctcatgaagtttatgattagtaattgcaaccgaaacttgatttctcatgtattccattaattccaaatcaccttcattaaaacaattattgtagatactatcaatattcaaaaatccatataattcactatctataataataggtgaactaataatagactttattttcattccctttgccgtatctagcatttttatattttctattttatgaatatcattgaaaatagttgttgtatctacattatttctctgattagcccatgcaaagtgctcttcgtactttaattcaaatgttttaatatcctctaagttataacctttagccacagctatttttaaacttttctctttatctaaaagcagcacagatccacaacttctgctatctatacaattaatgacttcgtccaatattaattgcagtaaattattaatattagatatctcgttaatcgagtaccctatttttagcattgattcttttaattttaataatttacttatcttttctttgctctttttttgttcagtagtgtctattataacgccaactaatcctttaacattatcatcttcatttacaacaactgatttattaaagattacatcatgatatgtgccatctttatgtgtaagcctttcttcataggcttgggattgcttttgactcattatattcttatctgaattactataaacttcagctagttccttttcgaaaatattataaacggtacttcccaaaaattcttctttactcattcctaaaaattctgtaaatgctgcattgcaatgattatatactccaaattcatccttagaatatataggattaggaatagcatcaataagtgtttgaagaaatttcgcattatcatatactttttttctttgcacttcaatctcagtaatatctgttaaaattagtattttaccaactatcttaccattattctcagatatattattaatatttatcttataatattttagctgttcttcataacttatactaatcaagctttcattactggaaccattctttataacatttaataatgttttatatttcctaaatacttcatcaatcttatgctctcctttacctatgtctcttaactctaaaataatattttttgctgaatcattaaaatttactatattattttcggaatccaatattataacaccttctagcatactggaaaataccttgtttaacgctattggggtaagctccaaaaatttgaattttaatatagcaaaactataaattattcccgaaaaagaaagcgtaaatggagataaatcaagagtaaatggtaacagcttcaatatataaatgatattcgcccccatggaattacccatgcaactattataagtaaaatttgttttctaataattgcagctgattttaaatatgctgctaccaaaaacactacccctgcaatcattagaatgtatgtataagcaatatgtatccaataccaaggcccttctattatctttgctattggaaaaactccagtatcattcatatgtagttctttatagaatagatgatgaaaatcattcgtacaattcagaataaatgtaattgaaggtattatatatagtaatgctaaaatattctttttaaatttatctttatatcctgtaaagttaagtgcgagcattaaccaaaacacagctataaatggaatacctaagtattctatttttatccagaattctactccttcgatgcttgtacataatatttcaaatccatatcctaatgcataaattgatacaggaatcaaagatattgaaacatatgatttatctcttttccatgaagaatatcctatatacattaatgttagcgcagataataatagtatcaagcaaaaaaaaatgtttagcttcaaaaacatcacctcatacactccattatactaaatatatcttgtaatattctacaattttatatttaaaataaaacataatgccacctaattctaaaattatggcatatatgtcattataaacgtgttaccaaattgacactggattattacgtctcccaaaataatccattctcagaatttcataaattcagtaacgactttgaatcttatactaatttagacttttgtgattataagattataagtttaattataaaacacattaaatataaatctaatgtggtatataaataagaatgatatcagtataggaaatactgatctttatatttcttgtaatattaaactaaagttataaaacacaaatatccaatctctaaaatatcatcttcaaaaccatccctaatgaattctatcatagcatcagtattattacctattattcttgaaaaagctacagtgtaattctttatgtcttcctcatctattttattttccatgcaatattttaagaataaggaataccttaacaataaatactctaatataatcatttggaatgaaataatcatctcttctatatcatcactgatacaattgctaaaaattttagatataatgcaattttcaacaaagtcgttatattgctcgaacaaacttttataatcattccatttagatgaaagttttttaattttagcattttccgcgaaattagcaatatcttttaaaagaatattaaaaatagaaacttccttataattctctatgatatctaaaaatagattattgacttcctcaactgagtcatttgtatttatctttattcccttatacatgtcaataagctcttttacataattcctatccttatacttttccaattcctttaataaggcatcttctccaagatcgtcattttctaaaatagtcgatagcatttgaaagctaataataagtttatcttctagtaaaaatttttcttgctgcattatgtttatgatggtttctctaactttaatttctaacgcattactttctaaataaatatgactttctgaagtcatatttattttgccagtctcactacctataaactctaatacttctggacaggaacatgataatgaaagctctcttctatcctcaaaaatattctctattctaggaaacatttggcatgttaaagataaataattttccccatgatcttttactatattgcataatccatggctgtctaaaagcggacatacttcatttgttttcttatttataaaatactcatctttaccttcatatctttttatttttacattatttaaaatattattagatttgtcatttttccaattatcatatgtattgtcatctacactaatatcccatccttcacaacatgtgaatttacacttatcagctgtgcacttaaacttatcatagtttgaaatttttaaggtatctattttattcatatatatctccagttttttataatattaacttaacattaaccattatagtttaattccttatccttagtatactgtttatataaaatattaacatttatttctcactttaaactatttcctttaaatataacgcttttataaataagatgctcttactttaccataaaataaaactctaaaaatataatataaaaaatccccttcactattatatcctcatgtataatagtgaagaggttaattttttaataattattgttctattaactgctgataaagtacatttcacattaatttcctgaattcgcagttgtcccacctgtcgatgactttgtatccacatttttagtagttccatctgtagaagttttctgatctgtattcccatttgttccacttgttgatgcctttgcatccgtattttcacttgatgttcctgatggcgactttaagtttgtgcttccatttgttccaccaattgttggtgcttttgtatctgtattatttgggctatttgcatctgttgatgtttttatatctgaatttcccgatgctccacctgcttgtgtctttgtatctggtgttccagtatctccattttgtgatgtttttgcgcctgaatctttatttgcttcattacctgaaacttttactggagaatttttattttttccacttgtcggtattttttcattcgcattcttagtctgttcaccttctgactgcgattcactcgttgattgcttctgaacttcagttttttcatctgaagtttttgcattagtggacatctcctgaaaatataatgcgcctaatcctccaatgcttataatcaaaatgagcgatataatggctattagcgcctttctattgttatatgagtttttatctctaccaaatctcgtactattttctttaccacctattttcttagcagtttgtcctttatttactgtagatctgcgccctctattagaagttgaagctttatcatccttcgttatattacaaattaaattctttatatttttaggcatgttaagtaatgaggatattattcctccttgctcaattgattgtatctctttaaaattttcaggtgatctaattgttacaacaggctttttatattctccatacttactttccacatacaatgtagctgaaaattcatcatctttacttaagaaaggtatatatacatctaaaatgttatcttctattgaagaatcaaatttcaaacctttcgttatttgagcatctccaattttcaaatcattttgtaacccttgtatatttaaggttaacttatgaattgttttatttgatatgtttcttaccgtaagaacatatgcacatatttttttgttgtttaattctagtggtacaccttctcctatattgcataatattttaggagccagatttttataatactctaacagtaatccagatataaatgatattattatagttataattgcagtttcgataacacttatcatagtaattttcgcttccttgtttttaaaaattgtgtaactaaattatagagtagagggatattcatgtcaaacttgaaaattaattataatttctccaataattcatatatagcagtacagattaatctataaatccatttaaattactattcataaatattctacatatgccatatttatgtttattattgactttttgttattattaataaagtgcttttacttttatttatcttctccaatatctatgctatttgttctagtagttcgttttcaaaattactgtttgtaaaaaaagatattgcaataaaaactctactgcaatatcttttgatatatactattttgtaaaaagtattcattcttaattcttacaaaataaaggaaatctactatatttattttgtaatagcctaacaattggtacaccaactattgtaacaacaacaaactcgccaattgcaacttccccaattgatagtacaagtggaaattgataaatatagttaagcatccatccaattattactccattaaagatggtaggccaaagcgatgctataattaatgatgttttcttattctttacaaacctttgtgtaattgagacagcataaacactaataaatgttgctaaagtaccaaatattatatctgctaaaccattaggtccaagaatatttgctataaaacatccaagagtaagacctacaatataaaacggatcaaaaaatgccagtaataccattatctctgagactctaaattgtatgggaccatagcttattggtgccagaacaagcgttataactgcgtaaagtgcggctatgatagctgttttaactagccttttcactgtattattattattcatataaactcctccattttactaataatatttttaaagttaacctgcttaatcaaccttccccataatttccgtactctcaaagaacaaaatctccacaaattttgcttcaatatagattcctagaaaataaaaaaatcgcaggaaaaatcctacgataaatatactcaacaaaaattaaagattccattaacacaaattaatttaatctttattattatcaattatttaaccgtagttttattttaagtcaggaggctttcgaactgactatatgttattttttactcttatgattatatcaaatagatgaactcaccacaagctatgcattagctttccactatatattctatattaatttattagatttattctaagtaaattaatatgaactttcaacaaaatctatatgttatatttctatgattttagtaagaaacatctaatctccgactaaagtatcaataatttctgtatcattagaattttcttaattgaattaccctcaatattaacttttagttatgccattaaaggcgcaagtgaccatattccttataaaattctcatctactatatcacctgttattaataatctataaaataatggaccaaaaactaaatccataactaattctatatctaaatcctcttttagttctcccctcgaaataccacgttctagaatatatcttgaatcaagtctacgaggcttaaaatatactgttcggtatgtttcagctaatttttgatcagattgtccttctgctattatctcattaattaccttcccctcgcgactagttagaaaatttgctaagttatttacttgaattattatatcatccatagttgatcctgtatccggaactgggagtctcacaacagctgcgtcaaaaaaagcatccataacaacagctgccttattggaccaccatttataaatagtagctttactaactccagctttctcagcaatcttttcaattgtaacagatccaaaaccactttcaagcaataaatcataggcagcggaaagaattgcatttttagttttctcgctacgagggcgtcctaactttttctccatatgtagttacctccattgtaattaacttatagcctatacttagtaaactatacgtctattatactatatatattatacttatcaattctaatttatctcttttaaacatttgacttaattgttagtgatattatacctcttatgcctttttaatagacttaaaaataatttttttatttcttcaaaaaactatttacaatactgaacgtttagtataatatatatttataaactaaacgttcagttttatcaaatgccttattattttattaagaatttttaagatatatggcgggaataatatttattaatattcaattaaaaacaaataagtaatagatcttaataaatttcattaaattatatgtattatgaggaggaaaaataaatgaaagttgtagcatttaacggaagtccaaataaagaaggtaatacttatcatggaataaaattagttactgatgaactagaaaaggaaggaatagaaacagaaataattcatgtggggaacaagtctataagaggttgcattgcttgcggatattgcacaaaaaataaaaatggtaaatgtgccattgctaccgatccagttaacgagtggattgaaaaaatgaaagatgctgatggcataattttagggtcaccagtacactattcagcaattgccggaacaatgaaatcatttttagatagggcttttcgtgtagccgaagctactgatagtatgttaagacttaaagtaggcattgcagtagtcgcagtaagacgtgcaggtggaattccaaccttcgatcaattgaacaattatattaatcattccgaaatgattattcctacttcaaactattggaatgtaattaacggaagagccccaggtgaagtaatgcaagatgaagaaggacaacaaattatgagaatcctaggcaagaacatggcctggcttatgaagcttatcgaaaatggtcagggagttataaaaactcctgaaagagaagaaaagatttttactaattttattcgataaacttttatctaatctaaccctcatataattgtagcattgatatttataagaaatttttattacttgtaaattagacctttgctcaattatatgtattatataattttaaggaagtgatttataaatgtatcaatcaactaatgctgtattaaaaacaaattcatcaatagataataccaatactagacctatattaactaaattactaatcttagttatgtcaatagcttgtggacttacagtagcaaatctatattacattcaaccgcttttaggagacatagcaaaaacttttcatgttgaccaattaagtataggttttgcagctatgctcacacaaataggttatgcaatcggaatgatatttatattgcctttaggagatataaaagaaaagagaaacttaatagtaataatgcttttattctcagtaatttcacttatgagtatgtttttctcttcaaatatatatattcttacgatctcttcttttgccgttgggtttacttctataatccctcaacttattattcctttggcagcacagctctcaaatccgcaacaaagaggacaaactattggcacaataatgagcggtttattaattggaatattactttctcgtacagttagtggcatattaggaagctaccttggctggagaatagtttatcttattgcagcaattatgatgtttactctcatgcttattcttagaaaattaataccattatgcaaccctatttccgacattaaatattctgagttattaaaatcgatgatacacttaataaaaacagaaccgatcttaagagaatcctctcttaatggtgcattaatgttttcagctttcagtgccttttggacaacccttatatttttacttgaaagttctcattacaatatgggagctgaagcagctggcttacttgggttagtaggtgttagcggtgctcttgctgctccactggttggaaaagtagctgataaaagaggttcaagatttgctataggcatatgtatagtcgtggttatagtttcctatttattatttttcctattcggattcaaaattttaggattagttttaggagtaattcttctagatttaggagtacaatcttgtaatgtatctaatcaggcaagagtacattctttaaatgaagaaacacgtaatagacttaatactatttatatggttagcttttttcttggtggggcgtttggatcgtttttaggttcctatagctattctcactttggatggtatggggtatgtacttttggtataataactcaaatccttgcgcttattatacacaagattagcaaaaaagcataaagttctattttgcatatttaaattttatttattagaatttcccttttattcacctgagaaataatcctgcattaatatatatgttgcaattaacaatgcatacttctcaattcacaattacagataaaattcttgcaatacttttagaattatgatgaagaattatttatcaaatatatatatattaatattatgtgataacttataaaaggacttacctttatatggtgagtcctactttttaataataacattgtccgctgcatttgccatcaagtaacttattttttatatattcttcataagtttcacttatttcagtattatctaatatagctatggccttttttagactttttatatctttttccatattctcaatagaatttcctcttccgactacctttaaatgagtaatgccagctttctttaacttttttagagaacataatccacatccagtttctccaatgaaatatgaaacttccattccctcttcgctttcacttccatattcattttctggatcagattgattttctatatagagttcttccttatccttgtcatttatatccttgtaataagactcaattctcttatcaacttcgcaaaaactactctcatttttatctattcttaatagttcatatggaactttacacaaatgtatcatttcatcacaatgtagggaactgcaaaaagcaccagtataatggcatctttcatttaaaataaatgcttcatattcaagattttctaccttattgcttcttatacatgatttcatatcttcgattgtatttttcctatgaaatatgtatcgtgatatatttagtttattgaaaaattccatagaaaaccggtttagttcagcacattctccacttaaatgtattgagcactttatattcctttcctttaaatataatataagcgcaatatctgctacaataaaatcattaaagccaatacttatcaaatcttttattatgttagctatcatttcatattgttcttcaagatagtataaataattaaaagttatatttactggcactttataaaaatcaaccattttctttagtattctcatgtcctcaagtgaatttatttgaatgttataataaagtacttctctcctatttaaaggaaataaactaccatattttttattccattcataaggaacatatccacaaaacacttcatctgctccagcctttactagttttatataatcatcaatacatcccattcctgctactatcttcattatgttttcctccttcatagataaacctatatgtgcgtttgtgaaatagttacatatcaccgttaaactctacataagtataagctcatatttcgatatctatagaaaatttaaaacaattctatcgattccgctatttatgtaatactctaattcttttggatttttaagcaaagtatcatcaaaagtgaatagcgaattatatcttccaaccatttttaagtgctttggataagaaaatacataatcgctacaatactttgggcagtcagtaacaagtttctgatttcctctatccatagttgtacacattgcatatagtggacaatattgagatgtatttgtttgatagaaaggaatatgcatactatggtgcccatctgcaatagaaattttataaccacaattttcatattcatatcgttctattttacattctttcaaaaacttcgtaaaaattgaactattaagactgtttgttgctataagctctttattttctaagtacccttttttgtaaatatatcttggatctttttttctcttatttaataaaacgcctagtgacagcttgaaaatatctatcttatctttaagtaattttagcattccaaaatcatttataataatttccatcttagtattattttcattacaccaattatatactgcctctattatatcttttgttttttctatataacactctctcatatatgtaaaacataacgttatctcaaggctctcttctttggctttctgcatcataccttttaacaattttatttctggaaataagttatgacaaaattcatttccaatataaatcctgttaatatctttcttaaataactcatgcccctctataaaattttcatttaagtaatccatcttaaatgtttggatatcattatccataaactttttatataatatatcattatctaaagaaatagctatctccactgaatcaataatatcttcatcccaatgcccataatttacgcctaacagccactcttctttctgttctaaataatccttatgaaactcctcatctagctttgccggataattaaccatttcctttgaaaattcattgccatcaccaaaagcttttaacataatataatttgaatactttttaaaagcacttcttacattatgtgagtattttcgtgattcaatgctgaaaatatatgttaaactaaaatcttcttttcttttttccactatattataatcttgtattattacctcttcatatctgttttcatcgaacttatgaaatgcaacttttatactgcttatcttttctatttcgtcagccacacgcactgtcaatttttcaggagatatttttattatacgtacttctttatcatctaataaacatgttattagtcctgctggcaataattcaacttcttctttttccaaaatgatacctcctaaactttttcatatatatctttaaaaacacttcatataccttattttatctgatcccacttaattcatcaatttaactatatatattttgcaattaagtttctacattataaattatacttgacttgtactatcagcaatagccattctcccatctcttttgcctctgacagaactttgagtataccagctatatggttttatcagatagaaatttaaaaatgacaattcttacagcattgcccgggtcagatactgaaaaaaagataaaacaatttctacggtgttaaatcagacgtagtgtactcttgaagttacattagtaaggaatactaaatgcatattttctacttagactctttcagacacttctatattcatcttgatatttcaactcaattttctgtacaaatttacctttaagcaacacgaaagcccactgaaatcaatgggctttctattacataaatataatatggttccagataagctaaagaaagatagtgctgtatccactatataaaagtatttctataatataaacttataaattctagattcatatggcttaagttctatactctcaatcgaatcattttcattaacattataatttgaaattaaaagttctttagatttaaattcaaattttctttcaagtacaaactctgtctcatttcctgtaaagttacatataactagtaacatttcattttctaaagttcttgtatatgcaaatatttctttgttttcttctaacatcaattcatattttccgtatacaactactggattggattttcttatttttattagttttttataataattgaatatagagttttcatcttttaattgagactcagcatttatttctttgtaattaggatttacttttagccaagactgtccacttgtaaagcctgcattttgactatcattccattgcattggggtacgcgcattatctctgccttttgtatatatagataacattatctcctcatgagtataaccttgtttttttctttcattatacatgtttagagtttctatatccttataatcctctaatgattcaaatcttacatttgtcataccaagctcttcaccttgatatatatatggagtccccttcattccatgtaataatgtagcaagcattttcgcactttctaccctatattctttatcatttccccaccttgaaactattcttggtacgtcatgattattccagaataaactattccaacctgtgccttctagctctacttgccatctagataatgccttctttaaatctaataattctaacggctttaaatcccatttttctttacctggttgttgatctaataaaatgtgctcaaattgaaatatcatgctaagttcactatcatctggatttgaatatttcttagctatttctgtagtacatccccaagtctctccaactgttagtaaatctttgcctccgaatgtcttcttattcatttctctaatatattcatggagttttggaccattatgcgtaacttttttatctggaatctttcctataagttcaattacatccattctaaatccgccaatacctttatcaatccaaaaattcatcattttataaattctattgcgcacctcttcattttcccagttcaaatctggctgttttttactaaataaatgtaaataatactgccctgtagtttcatcatattgccatgcactaccgctaaatgttgatcttaaatcatttggttcttctccatttactggatctctccatatataataatctctataaggattatcttttgatttcttagcttcgatgaaccatttatgttcgtcagaagtatggtttacaactaaatccataagaatttttattcctcttttatttccttcctcaataagatcatccatatcttccattgttccaaattcatccattatatcttcataatcgcttatatcatatccattatcatcgtttggtgatttatatactggagataaccatattacatctatccccaattctttcaagtaatctaacttctctattattcctcttaaatctccaattccatctccattagaatcattaaaactcctaggatatacctgataaacaacgctttctttccaccattttttatccatgacttattctccttttaatattacttattttatttcgtttaaatgcatttttattatttaacagctccagtgacaataccatttcttatccatttttgcgcaaagatgtatacaataaacattggtaataatgctagcaagtatgacgcaaaagccagattataatttgtagtaaattgagactggaatacgtattgaactaaaggcaatgtagccatttctggcttacctaagataataagtggcaacatgaaatcattccatgtccacaaacaagtagtaattgcaaccgtagcattaataggttttagtaaagggaaaattattctccaaaatacttgaaatgtagaagcaccatctattgttgctgcttcttcaagtgaaactggaattgatttaatataacctgaatataaaaatatattaaaaggtagtccaaatacaacgtataaacatattattccaattatattatccatgtttaatatatttacttgttttacaagaggcagcataattattggaaatggtacaaacatagcacttaaaaagtaatagtataatgcattaaaaaactttttctttctatttctagctatggcatatgaaaccaaagaatttgagagtattgtaagaattaataccgaaattgttattgttaaactgttttttagagcatcaaagaaatttgtcatttcaatggcttcagtaaaattttcaaaacgcaatgcctttggaaatgataaagcacttggtaccatatcttgtggagattttacagctattaatattgttagatacaatggaaatattatagccaccaaagctcctgctatcataagcgtagttactatccaattggttttgtttctcctcatagtactttttcctccctcttttcaaggactctaagctgaaataatgatattgctacaattacgatgaagtaaataacagcatttgcagattgatatgcaaaacttccttggttaaatcctccgttataaattacataagatattgattgagtaacagttccaggtcctcctcctgtcatagctacaacctgatcaaataccattaaaaatcctttcatacataaaaccatgttaattgtgaaaaatggtgctattaatggaaatgttatgcttttaaatctttgccatgaaccagcaccatcaatatcacaggcttcgtaaacatcagtatcaattgtctgaagtccagataaatatattattgtattaaaggctattgattgccatgctgctacaaacactattccaagccatgcaagcttttcatcacctaatatgtttttactaagcatagaaatgttcatagtctctccaatgtttggtataacatgagcaaatacaaaattgaatataaatgccactattaaagttcctaatatattaggaataaaatatattgactttaaggtattttgaaatttgatttttgagtttaagcctacagcaattaaaagacttaatatgtttactataattgtagttataattgcaaatttgaaagtaaaaatgtacgcatgcataacattactatcttgaaacactgcaatatagttttttaatccaacaaaactccaatcaccatatccttttgaattggtaaaactataaaatacaccttctaaaagagataatgtatgaaatataaagaataacaaaactgctggtatagtcataatataaaaagcttttttcttcttcaaaaccttcagccccctattattttttcatttgacaaataaatattattaacatataacataggttgtcctaaaatcagtctattttcctaaaaatattatttttcatgtttataaataaatatcgagctacagccatcttttaggacatccttataccttttattttctcttatttattgcttgctattagctttatcgtattcagtatcaagttgttttaagaattctgccttatcttttttactatagaacccttgaactaaacttgctgcatcaaatgagcttggatagtagtgatcagggaaaacaccaatttttccatttttaaagctttcttgtacatctgttacactttgatcatcttgtgtaacatctttaactgcagaaaatgcaaattgatcttttatatatttttgagcattctccttttcagtcataaattctatgaatttttttgcttcatcagaatgttttgacttacttgttattccaaataacacatctataccagatactatattatttttagatggatcattacttgcaggtaatgggaacatacctagatttatattaggatttgctttttttatttcactaatagcccagttaccttgtaaatacattgctgatttaccttgtgcaaaggctgcattaccatcattgtatgatactcctaaaatatcttcttgcccaagagttcctatattctccattttgtccactatttctccatgtgtagcttcaaaagttgtttttcctgcttttttatcagctaagaaattactaggctccaagtcactagctatgacattccagaaacacattccagtccacgcatctttaagtgtcaaataaagtggtaattgacctgcatctttaatctttttcgatacagccataaattcatcccatgttttaggaatttgcaatcctagctttgaaaatatatctttattgtatagaacgccatcagcattagtagcatatggaactccatatatctttccattatcattacttgctatgccatgaagcatatctaaatatggtttttgtatgttttcaataatgccatcattagtaagatcaacaagggcatttgcatctactagtgcaccatagtttacatctgcacctaaagctactaaatctggcatatcatttttagcaagtcttgtttttaaaacagtaccagcatttgcaggtgaattaattgaaatttcaatattaggattcttttcttgaaattcatttgctaatgattgtaatattgttttattttctgccttagttgaaaataactctaattttacttttccattttctgtgctgcctcccttagaaccacatcctgctaataatgaagttccaattactgcactaatagtaattgacattagtaattttaattttttattcatttctcttccccctactttgtaatttcagtatacgattacgtagatttaatattatattaactatactattttaggcacatcagccttaagaagtacattttaatatctttttttgtttgttaatacttaatcgtttacgtaaactataaaaatttacgtaatatttttctcaaatcttatatgaaattatattacaaagttttaaacttagaattgtatatagaaacttgtaatatagcttcatatcattttataaataatcattgaatatcttatattcctataataatttatatattactattaactttctacatttaaatcataactgagtatttaatatcttatatctttaaatgtagatttattagtgcagtctatatatctttaatttttttaactgtctctctttctataatttcaaatggcattattatgctttcaactttttcgttgtatgatattctttttattaacatttcaacagactttttccccatatcatataaaggttgcgctactgttgttaaaggtggatatgacatctcagctatatttgtgttatcataacctactatagatagatcatctggtacttttaaaccattcttatgtgctactgataatgctccaacagcacaatcatcagatgccgcaaaaacagctgtaaatttctcacctgtctctagaagttcattcattccttcaacaccatctataaatccaaaccctttttctttaataagatttttctttatggatatgttattatctcttaatgcttgcaaaaatccatttaaacgtggcactcctgctatagggtcttcagtcggtccagatataattgctatctctttatggccattttcaattaaatatgatgttgctgaataagcagcttgataatcatcaaccttaacataaggtaatgaatacttgtacgataatcctgaaacaagaactgttggaatatgtgagtctattattcttttgcataaagtatcatctggaggtatgctacaaacaattaatccatctacctgtctttcagataatacctgaagatattctgacattcgctcccacttatctccaccattacagattataacgctgtaattattgcgttgcgcaaaatcttctattccatttaaaatttctacataatatgtagtgcttatcttaggacgtaacactccaatagttcgtgtttctttaaccttgagatttctcgcaattgcatttctttgataaccaagttcatccatagcttcaattactttttttctagtctcttctgaataaccatctagattatttattatcctagaaactgtggcaacagaaacattggatttcttagcgacatctttaattgtgggtcttttaatattactattcataacatattcctctttttcagtaaacgtttaagtaattaaatcttatcataattggatttaattgtctatatcttcgtataatatttttttatatttttaatttctatataaaattagctgtttttatattatacgtttactaaacaatgaacgcttaaatcttcttacaaaatatggctttaaacttcacttaatatcttgcagagctatcaattcaccactatactatattatgtgaagtatttttggcatgtgctaaagcgtattcaaaatagcaggcaatagccagtctattttatatatagagtccagactcttaaaatataaaatctataagaaattacgagtttcttaagagaatgttttagagtccaagtataaaatattcatagcaaatttggacatgttatttcatgtatctaataagaattcggcgaaatgagagggagatttatgaacaaaaaagatatattagaattaaaaagacgtttaaaaaaagatgactgtacatttactaaaatgtgtggttgttatgtagatggtcaaaaagatattgtattaaaatttaaagaaacttttttaaatctaagagaggaagaattctttaaatatttagaaattgccaagaaaacactatctggaacagttggaaataacattcttgaacttaactttcctcttgatgaagaaggcataggtggcagacagctttccttaatggagctaaaaaaaagtaaattaaaagatgattctatgctcgatagcttttataaaatgattataaatagttatgaatatactggtaactttctaatactcgtttttcacgatgcctatgatgttatgacaaaaactacggataactcaaaattagatgaatctgaagaggtatatgaatatatattatgtgcaatctgtccagtatcactttcaaaaccagctcttggatatcttgaagatgaaaatcgaattggagctcgtattagagattgggtagttggtccaccagaccttggatttgtatttccagcatttatagatcgtagtactgatattcattctattatgtattacacaaaagatgcaaaagatcctcatcccgaatttatggaggaagctttaggttgtagttcaaaacaaacagctactgagcaaaaagaaacattccaaaatataattcgtaaagctgctggaagtgatgatgaaaaatcagagcatttatttatggaaattcaagaaactctcaatactatagtagatgatcatactactgttaacggcaaaaatgctgagcctatagttttgagtaatgataatattcaagatattttaatcgaaagtggagttcctgaagagatcactgcaaagattgaaaaatcatatacagaagcatttggagatactccgcctgtagcagaaaatttaattgataaaaaagcacttgcagcaaatgaacaaagaaaaaaggaagaaaaacttgaaaagaaagtacgcatattagaagaaagacttgaaaagacaaaactggatgctttagcagattcagagaaagaagctgctttagaatcagaaactgaatcagctttgaataagatcttagagtcagagcctaattctgctttaaagacagaatctgataccatcttagaagtggcttctgactctaatttagatgaaaatcttgattcagaaacagcatctgatgcaaataatactgaaaacactgaaatagaaactgagattagcgatgctccaaattatgatattgtacttaatgtaaaacctcaaaaagtatctcaaataaaatcacaaataatagacggaaagaaatgtattataattcctatagatgatgatgaacaagctaaagtaaatggcgttaatgctttgctttaacttactgcaaataatacttttctcatttaaatagccataaagatcctgattaagggtctttatggctattataatctatatataattcagtaatgagtttatatttaaaattcgggaagttatatacctgattaaacctaaaatatagaggcttgattctaatacatataatatgattcaatattcattactttatatacattccaccaggagtttctgataaattaactatgatatttttcttttgagtatacgcttctaatataactttgtgagtttccctgcctataccagattctttgtatccaccaaatgttgcacctgctgggaaagtattataagtgttaacccatatacgtccagtccttatttctttagcaactcttatagcacgatttaagttagtagtaaatactccaccacctaaaccatattcactatcatttgccatagcaatgacttcttcttctgtcttaaatttaattacaactccaactggcccaaatatttcttctctagctattctcatatcattagtaacatctgtaagtaaagtaggtttcataaagtatccattcttagcatcaccctcaatgaatctttcccctcctgtcgctacttttgcgccttcttttttacctatttctatatatttaagaatttttttaagttgagattcactaacttgcgctcccatttgagtattaggatctaatgggtttccaactttgactttttcaaaagcagcaattgctttttccataaattcatcataaaaatcttcttgtacaaatattctagaacctgcagaacaaacttgtccttggttaaataaaattcccaattgaataccttctaatgcaatgttcatatttgcatcactaaagaaaatattagctgactttcctccaagctctaaagttgcaggaataatacgtttagccgcagcaagtccaatttgtcttccaacttctgtagatcctgtaaatgctaatttatcaagtccttcatgattttgcagatattcaccgctctttgatccttttcctgtaataacattaattacaccactaggaacaatattttgtattagtttcataagctctaatacgcttaatgaagtagtacttgatggcttaaatactgaaacatccccagctgctaacactggagctaacttccaagccgccattaagaatggaaaattccaaggaactatttgccctacaacaccaattggctcacttaatattaaatttaaagtattttcatctatcattgttgcagaaccctcatcagcacgaataacacctgcaaaatatctaaagtgatctgctgctaatggaatatctgctcctgttgtctctctaattggttttccattatctaaagtttctactgtagctaagtattctgcgttttcttcaataatatcagcaattttatttaatatatttgctctttctacaacagtagttttgccccatgtagcaaaggcttgtcttgcagaattaacagcatcatctacatctttttctgtagcatctgcaatctcagctaaaaattccccattagctggattataagtctttattgtagttccatctgaagcatctctccattctccattaataaataatctatatctattttctaatttaacattcataataaacaccttttttcctcatataatcgatcttttataattttattatagcactaaattaattgtattcaatataaaataattatttaacaataataattatccatataattattggtaaatattgaaatcacatggtgttcctgtataatattataaaatttttttatttaaagacaaaaaagtataatataaaacaaacactttgttaagaatttattttatattatacctttcatatttgaaaaaggtgctatatttatttcttattaataattaaaatttagctctcttactctcttttcctattcctttattaaaatgtctaatgtatgtgcacttgctccaagcaactctggtctttcacatgtagaaaaatgatagttaataaaaagcttaaatgtctcttcatccatagcatttaaaacagatctcatgtaattcgctggcccatctgctgagattaattttatcctttttagtcttacttcttcatttaacttattgatatcttcaatccttacataatcatataaatcttttggttcagatataacatgaaaatcatcagtaagctttccattttcaatagatgaacgaatattattttccttaaaaccatatgttattacgctatattcattcatgcaataagctactaagataactcctccaatttttgttactctcttcgcctcttgtaaggcttttgctttatcctgaaaattgtataagtgatacatcggtccaaataccaatgtcatatcaaatgtattttcttcaaatcttgataaatctaatgctgtcccttgatatgcttttactgaacttccttttgatttcaaaatacctagattatgctttacaagctcaattgctgtaacatcatacccctcatttgctagctccacagagtatcttcctgttccagcaccaacatctaaaattttggaaccattattcttttctagatactcatgaatatatttcatagaagttaaaaactcaacttgtgcatattttctagttaatcttttatcttcacaaaatttattatagtatttctctaattccattgtcatctctttacgttcctcacctatcatttattagaaattattaaatataaatattaatttctttcctgatttctaacaactattatactatatattgcaactattaaaaatatagatttattctttaatattctccttggaaactattatggttttaggttctagatgttcttgaagtccgtatatgccgcattctctaccaattccagactgtttaaatccaccaaatggtgctttcatctcaagcataacatcatttatataaattgttcctgcagcgatttgagaagcaatttgattcgccttttctatattagaagaacttatatatgcccctaaaccatatactgtgtcatttgcaatttctacggcttcttcttcggttctataagtcaaaatagataaaactgggccaaatatttcttctctagcaatagtcatatctctagttacatttgcaaaaactgttggctttacaaaattaccattctccaatccttctggatgcccttctcctccaactatcagttcagcaccttcttctataccaatcttaatgtatcgttgaacattattatagtgattttcatttatcataggccctataaacgtatcctcttcccatggatatcctaccttggtattttcaacagcttttttaataagttctttaacttcactaagacggtattctggaaccaatagtcggcttccagcaatgcacatttgtccattatttccgaagcagctcataattgcacgtggaatagcttttgtaaaatcagcgtcatcaagaattatatttggtgattttcctcccaattcaagaattactcttttcattgtatcaacagcaccatgatgaataatcttagcagttttagtagagccagtaaaagaaatcattgcaacatctggattacgagttaattcagcaccgaccgaacttcctaggccattaactatattaattacacctgatggtattcctgcttcatggaaacattcagccaaaatttgagtttggatagcgcaaaattcactaggttttataactactgtacatcctgctgaaatagctgtagccacttttatagctatctgagaattgtttgcgttccaaggggtaatcaaagcaatcactcctacaggttcaaggacaaccttggctttaccaatatacttagtgaactcaaactcttccatcacttccttagcccagagaaaactattagcagtaagttgagttctgcctgctgctgccttaactgccgcaccatattcttctacgcatgcttgagttaactcatcagccctcgagattacagcatcatataaccttttaagcatatcacttctctcttctaatgtagttttggagaatgttttaaatgcttcttcagcagctgcaatagccttttgtgtatcaacctcatttcctaagattacacgtccaattatttcttttgttgaaggatttataatatccattgattctgttccattaggttttataaattctccattaatgtaaattttgtcaattactttaatcttttcattattcttcattccattgcctccaaattgaatttcatatttctatatgctataatcactttaatacattcaagtaactttaagtcaagaaattttaggagattttttatggaaaattttatttatggatccgaccccaaatatacaattaatgaagtttctaaaataactaaactatctaaacctactattcgttattatgaagatatcggattactccaaggaatagctcgagataagaataatattcgtttattttctgatgatcaaattatgcgattacgaatgattcaatgtatgcgaagtacaggaatgggaattgatctaattcgccattatattgatctatctaatgaagataaaatgggacttaaagaacgttattccattgttttagaacaagaggaaatacttttagcaaaaaaggaagagattgaaagacaattagctttcattgaacataaaaaacatactctaaaggaaaagcataataataaaaaaatcacccactaaaatctaaactttagattttagtgggtgatatgaagttaatgtaaagttcaaattaataaaccaactattaattgatttgatgatattttataagtcaatataactataattccctattatcttataattgtcactgcattttccttcaatacttttttctctggcttaataccatctatataaccaatacaaatagacccacaaaccttatgtttttctgaaattcctaagcgtgtaagtaactttcttacattttcatcattgtcaaaccatgttaattgatttatccaacatgctccaagttccaagtaatttgcggctaaaagcatattttctatagcacaagcactatctgccattgcattactatagttagactcattcgatactataatcaatgttggagcgttgtaataaaaattgtagtcatctttcttcgatgcaactttacctgcttttttacttttataggtattttcatcaacttcaagcttttcaaaagcttctttaatatatctatttaactctaaaagaatttctttattttgaactacagtaaattgccatgtttgagagttacctccacttggtgcatgttttgctgaatctaagattgtaaatagttcctcatcttttatttgttcctctttgtattttcttatacttcttcttgattttatattttcaattacattttccatattaatcctccttgtataatctagttgtaacatttgatagaaaactatttatctttctaacgaacattacacctcttattatttttaatattctaatttattactttgcctacgccccgatagggaatatgcatttcatatcttaaatagttttttatttaaattccttaaaggaatctaaccaagttttatatagtctagtataatactcctgaatagaagatagatgtaaacctcctgggaggtcttttagaacctatacccgtaaaaaagcgtatcatttcatcaggtagaattctatgtttagctggttgggtttcccttcgggaattacccgtgtcacaaacaaggttataagctatctgacagagtggaagttctattctatatctaaaatttaatttaaggagatatatacaatgtctaattttttttatagtcctgtaataggaattgatgtttcagctgatttttcatatactgcaatactcgcaccgaatggtgatatttataagaagtcatttaaaataaagcatgatctcaatggcttcaaccacttagttaatgaaataaaaaaagtggaagaagagtttaacatgaaaactgcaattttcatggagtccactggcgtgtaccatttatctcttttccactatcttaataaatatttcgataacacatttgttatcaatccactcgttactaagtctaacaaaaatggcgacataagaaaagtgaaaaatgataaaaaagacgctttatctattgcaacaataggaaaatttcaaaacattaagttatcacaacaacttagccttgatatttttcttctgaaaaatcttgtaagagagtattacaaacttacagatactagctctacttttaagaaaaaattatccgctgatttaagagttatttttcctggctataatactatattttcagattcaacatctaaaagttcaattgagcttttaagtcaatatccaacgccacaatcaattttagaggcacctaaggaaaatataattaagattttccttgatagctctaaaaagggcattatctggtcggaaaatacatattccaaattatttaaggttgctaatgaagctaaaataattggcttaccgttagacggtttagccgtcaaaatagccagctctataacattaataaaaactattcaatcagagattgatatattgttacagaaaattaacaattttatacagtctgaaacttttcctgaatctattagagctaatattgaactaattgattcaattcctggcatagggcaattaactgctattactataatagctgaaataggtgatattgatggttttcttaagcccaaacatcttgtagctttctttggtattgatagctcagttaatcaatcaggtaattttaaaggcgatgataataaaatttcaaaaagaggaactcgaatcggtcgaagagcattatattctgttgcactagcttcaatccgtaacaatcgtaatggagttcctataaataaagtcctattagattattatcaaataaaccttaaaggcaaaaagcctaaaatcgccttagtcgctataatgcataaaattataaactacatttttgctgttctccgaaatcaaactccgtttgagcaaagagatcccaaaatacataagcaaatgttcctagaaaataactctttaaacaaagtcgcttaattttattccaatttctgtaaccgttcgtgttttgaaacggtttgtttgccatactctttttccaaaaactattttttttaaaattaacttgactattattagctggtctttttaataattatattccaagtctaattcaaataaaatgctaatcttggatattagaaaagtgattaaaaccttgcaatcacttttctttgcctatttaatgatatctaaagatataaattactaaataatgtgccataacctatgccatatcgactctttctttaatattctctcctcttttagaatataaaagaaataaacttaaccctagtgcaactacaaagaaaattgtaaaaaatctgaaactggaatctatagacttaactaaatttccacttatatttacattagaaaagcttcctaaacctataattgccttagagactacatccgcaggtataataacttctattgttaatatggctaatgtctgacttaatgctttaccaacattcattatagtataatgcatccctgatgctgaaccagattgttctttaggcactgctgacaatacagttttcgctaacgacggccaagctaagccatttgctattgataataatattagtggtgtaactatagctttaactgatagctctcccccaagatttccaagaaagaatatccctataataagaaatactataccaaatgtaagagtctttaatgatccgatattatctacaagtttacctgcaaatggacctaatataagttgtggtacagatagtgaaatcatcaatagccctgacatagttggactcaaatgtaatgcactttgcaaatatatactcaacaataaaggtaatgaaaaatatgcaatacaataaaataatgtaattacaagtccaattgaataatttctatacaaaaacagcttgaaattaaataatggattttctacacgtaattctgtgattataaatgcaacccataataaaattgtaactatacatagccctaaagttttatatgatacccatcctaatgattgtccttctgaaagtactatcatcgttaatattaaacctaagctaaatgttaatatcccaatccagtcatttttttgattaatattaggtttagtctcttccattactaaaaatgctccaattatgcaaagaagtacaaaaggtactgtaataaagaatattgatctccaaccaaagctactaattaaagcaccaccagctactggtccaattattgctccaataacccatgaagtagcattaatactcaaggctagcccaagctcattactatgaaaagtcttaattatagttggagttgcagttgccatagctaatgctgctccacctccttgaattaacctatataaatttaaagttaatcctgagtctgcaattccacaaagtattgtaccaactgcaaaaattataagtcctaacatgaaaatacgctttgttccaactgtatctgcccattttccagcaggcaatattaaaactgtacttgcaataatgtaaccagtaattatccacaatccagtagttactgaaatatttaatccttccatcatattaggcaaacctattattacaatagtagaatctaaatttgtaataaatgaaactaatgtaacaacaagtagaatgctccatttgtgtgatttagaatttgtcatataatctccttatttataaatggaataaattttcgagtgtagataaccccttatatgattaatcccatcgaagccatttaattttgttttctatacatagtttacaagagattatatatcatgtaaaatgattatataagatatcaagattcacttttagtgatttatatattggggtgataaaatggaaagtagtgaattaagaattttcagagctgttgctcaagcaggcagcataacaaaggctgcgcaggctctgggatatgttcaatctaatgttacagctagaattcaacaattagaatccgatttaaatacacaactcttttatagacagcgaggtatgattttaactcctacaggtgagaaattattagcttatgccgaaaaaatcatttatttattggatgaagctgataaagccttaaatgattgttgcgatccttcaggaagtttatcaattggtgctgttcacacagtatctgcaatacgtcttcctgaaatcttatctcagtatcataaagcttaccctaaagttgatctatctcttataacaagtcaatcagatgaacttatttataaaataaaacatttccagttagatggagcttttgtcaaagctcagtcctttagtgatgagaatatcgtaagtgaacttgtagtcgaagaaaccttagtactaatatcaagtcctaaatatgataatatagaagatctatattcaaaaccatttttgatgagtacagcaggatgtcctaatagaacacaacttgaaaactggctcaaatccaaaagcattcataatattcgatatatggaatttaataatttaacttctattattgaaggcgttattgctgatcttggtgcatcatttgtaccaaagtccactattgaagattatgaaaagaaaggacttctaaaatcattcccagtgcccgataaatataatactacaaaaacattttttataaggcgtaaagattctttaatgactaactcactttcaaaattcattgaaatgaccgagctaaatacaccatataaaagaacttaaaatattagctaaatcccccatgaaaaatcagaatttcgtggggaatagttatgattcccacccttgcacgtaaatcaaatattaagtcgtatttttctttttgagctaaaaagaaaaatcactaaatacactttcgcctttacctaaaggctttctatctccttcataaaaaccgaattcatcatcattttcctcatcggtaacctcaatatccgtatttttccttatatctttcttcggcttcttatttttattcattactaaaggtacagggatattgtctttcagtccgctattaatttttaccgtgcttattatgttcttattatcgctgattcctgcatttttaatttctatattattcttagtatcaattgcattctccatattacacatattgttgtctttctgcttctgtttttgaataatttcattgccaatctcttcttcaacatcatgtttttcatcatagatattttcaacacttttagtttcttcgctttttaacttactatcctttttactcattttttctttattctcatcaatatcttttacctttactttgatattttgatgctttgcaaaattctttactttataaacattttcttcaacaacttcaaccatttctaagtctataaatgtatctaatgccagttttacttgactttcatctctattaaattctatagctaaagtctttaatgtatatggaatgttttttgacatatataagttgccatctagattaactttcccagctaaaattacaattctggtccaaatataataaataacatctctttctggcattctatcaattattttaaattttgtatcctcatacatatcaactctgaatcttacatatcttctctctttcatcttaatcgctcctcctaaaaatttttatttttctattcttttcaattaagatatatgtctcaattcataaaataacagaatatctataaatttttttctaaaactttttgaaaactaaaataaccttagaaataactaaaaaacacgaaaatctaaattttgatatgctccctttatagtagacagttaaaataataaaactgtttctataaagggggtattttaatgtcaagaaaaacgaaatgttctctggaagagaaattgaaaggaattaaagaatacctatcaggagaaaaagcagttatacagatatgcgatgagatgggaattcatagtgccacattttatgactggttgaaaatatataatgatgttggtgaagcaaatttaatagtttctacaaaaaacaaatattattgcgattcgcttaaacttaatgcagttaaagattatctagctggaaaaggctctttaagaaatatatgctgcacatatgaaatttcatctcctcgtgttctcagcgattggattaagaagtataatggtcataaaacaattaaatctcataataagcaaggggatagaattatgactaatggaagaaagactacttatgaagaaagaattgagattgttgcattctgcatttcgaataatgatgattatcaagctactgctgataaatttaatgtttcttatcaacaagtttatacctgggtaagaaaatacaaagctaatggatatgaagagctaatagaccgtcgcggtaagcgtaaagatactgatgagattactgagtctgataaattatccgcacaattaaaacttattgaagcagaaaatagacgtttaaagatggagattgatttcttaaaaaaattgaaagaagtagaaagaaggcgataagcactaaaagactccaagaatataaatatatttctataaaagaattacatgaaaaaaatggctatccaatggctgatctatgcaatttagctgggattgcacgatcatcttactacaaatggattaaccgttcagagactgaattagataaggaaaattcaataatactaaaagagattgttaaactttatgaagatgtaaatggtatctatggataccgtcggataacaatgaatataaatagactcctggataaacagtataatcataaacgaatttatagattaatgaaatctattaacatgagatcagttataagaaaaaagagaaagcattatattcaaagtactccacaaattacagcagaaaacaaattaaatagagaattttatgcaaagaaaccaaatgaaaaatggttaacagctgttactgaatttaaactacttaatggtaaaaaggcttaccttagcgcaatatttgatttagctgataagagcattgtttcttatgttgttggtcactcaaataacaatcagcttgtttttgatacatttgatttagcagtaagtgctaatccgactgcaaagccactgtttcatagtgacagaggatttcagtatactaataggactttcaaagctaaacttgataaaatcaaagcaactcaaagcatgtcacgtgtcagcagatgtatcgacaacggaccaatggaaggtttttggggaactctaaaatgtgagatgtactatttgcaaaaattttatacatatgaagaattgagacaagcaattgatgaatacatagttttctataatacaaaaagactacagaaaaacttaaaaggtctgactccaattgaatatcgaaatcagaccttggtttcataattttttgttttttcatctgtctacttgacagggggcagttcaattttagattctcgtgtttttttatgatatagttaataatattaccttcaaaataatcttttgctactaaattaaattgatgcttttctttaattacatctattcataaaattatttttacttaatattattggagttacaggttcaccataaaaatcttctgcctctccaattactttgcattcaaatttcattaacatatttagagttgcatctcttgcttcaatgtaaatttcgtcagtataagaattaaaaatttcttttaatgaaactatagcaagcttctgaccaattcccatgcctctcaatcttttatcaacagcaaatcttccccaatgccatttatctttttctttccatgctgatactacgccaataatatcttctcctactcttgcgcaccaccaaattggttttaaattttcactcactggaaccaattcttctggaatgctttgctcattagtaaatacttctgttgctaattcaattgcttcttttatataattttcagaaattctttctattaatattctagaatcattcttcttgagattgttttttaatgcaagaacgcgaaataatctaaatgctcccacaatattttctgtatcttcactatcccctaaatttaaaatttcattaataaatttatttgcttcatggtctccactatttatagcctcaatacctaatggaagaatacaaatatctttcattcttttatcagcttcagatttcttcagctccaaataatttttagcctccaaattattaagtatcctgcttaacgaagccttatcaatacctaaatttattagcaattcattaaaaggagtttttccattttgttttatgtaatttaatatatgagcttgagccagtgttaattcagaatttaggcaattgtgattaagcagccctaattctctcacaattaatcttacctcttttctaattatctcttcgtttctcatattcgcctccaaattaattgatattatcaacaattataactcactttcgtttttattacaagttgacttcataaatcaatttataatttacagagcttttatgactattacaggaaagaaataacgtgctacattattctgaattcttatgctaaaaatatggcataattatgattccattaagagcaataagcttaatgatgaatattatttattctaagataagctgctttaatttattctttgtttcatcatctataggcatttgaatggtgatacttgctccctctatttctgtggacctaaatgaaatataacttaggtataaatcccctactaaaggatgatgtaaaagtttttgaccttctggtgttcccataataccttgattattccaccatttattaaatagaggatctttttcatttaattcatttataattgcatttattgtattatcattctcataataaccgtaatttgctctcaattgttcaacacgtaatttagaatgcccttcccaattatctaacagttcttttagataatcatcattaaaagctctccaaactgagtttctttctttttcatccatttcttcataattaccataaacttttagtgccgccatattccatccaatcattgttaatttactatcagtaacataagctatacttggattttgattgtctaagaatttttgtaatgtattagaaatagcaacagctgcaaagtcttctacaggtaatttcttatctgataaattaaataaatatcttttttcttcattatttaattgcaaaaccctactcaaggaaagtaacacatctattgatggattaacatcttgtccttgttcaatacgcacataccagtcaatacttactccggctaaatcagcgacttcctctctctttaatcctttcacccttctttttttatcaaatttgagtccaaattgttctggtcttaatgtggatcttttcttttttaaaaataatccaagttctttgcttttagatatcattattacctccccatctctattcatataaactttattattatatatgttgtaattcacaatgcacatttcacaatcgcagctaaaattcttgcaatacttttagaattatgattaaggtctgctaaacatagtattattaatcatatgataacttagcttctatttaaaataatactttcattatacactatcttcataagctatagagaggaagatgtgaaaatgaatagagctttagaaaacaaaagtttttcaaacaaattattatttattttatcaattatttgtgcaattatggtagctaatttgtactacgatcaagttttattaaccaatatttccaatgatttttttatacctgcttcagcatctggtaagcttgtaacagctatacagataggatatacaatgggattgttgttcattgttccactaggagacaggtatagtagaaaactattaatcattttaagtattatttgttcagctatattattatatttaatgactttagtctctacctttaatttaatagtaattataggcttttttatggggatttcaagtgtttcagcacagcttataatcccatttgtttcttcaaatatttcgtcagaaaaacgtggtataattgttggtcacttattaaccggagtatttcttggagttttactcggtagagttctaggtggagttctaggccaactaattggctggagaggagttcatgaatttgcagcaatagttttattaatttttgcagtatacttattttattctctcccaaatgataatgtaaaaaaggaaagttcatataaaaatatcatactatctttacctccattattaaaaaaagaaaaagtattaagagaaacaatagtttttggtgctgctgccttttgtgcctttaatattttttgggtttcattatcctttattttagaaggttctccttatagttatggaagtgcaatagttggactctttggctttttaggtatagcaggtgcgttagccgctggattttcgggaaaacttacaaatagtaaaaaagtaagcttatggaacctttttgctttagctataatgtttgtttcttttttaatcttaggtgtaggctggtccaaacttataattataattctcgtaacctttactttagatgttggttcaagaatgaatatgtctctaaatcaaggaaggatttataagcttagcctccaaaatcatagcagattaaattctctttacatggttgggtattacttaggtgggtcccttggatcatggataagtacctctgtatatcattcatttggtgttattggaatcacaattgcaagttgcagtgtacttttgatagcatgtgtttattatttaatcactaatggtctcttaaatagagaaaataatactaaatcctcaagtgcatttacccatggaaatcaaccaactcgtcagtaatttgtgaaatactttaagacataatcaaaaaaaataacaagctcatattcccaaaaaattatttactgctaataatgataatactgctgtgattatttatcctatgataatttatcatctatttaaaagaattctttaattgtataatggattaaaaagaatttactttcattaattttgtattgttaagcatattatagatatctttaatacgataatactattaaataaatcttattacttaaaggaatatgtttaaattaaaggagaagataaaaatgaatttaataactgtaaatcaagataaatgtattaaatgtggtttgtgcgtaaatgagtgcccagaacgtgtattagaacctagtgaaaatggacctaaagaaatttgcggtgaagagtgtatttcctgtggtcattgtgtagctatatgcccaagggaagcaattgataatataaaaacaccattagccaatcaaatcagttcaaaaagatttccaaaactaagtcctgaggaagcagaaaactttcttcgttcaaggcgttcaatccgctcatataaagagactcctgtcccaagagaaaaattaatagatcttgtgaatattgcacattttgctcctagtggacataatcttcaaggaatatcttatactatcattgatgatagaaagatacttgagaaagctgttaaaattgtcatcgaagaatttgaaaaggataatgtatcgagtgaattcacaaagccataccgtgaaaaaggaattgatacaattttgcgtggagcatccagccttgtcctggcaactgctgattcaaactttccacgaggaagagaaaattcaatcctttcattaacatatttagagttatatgcgccaacactaggcttaggatcatgctgggctggaatgtttgaaagaattgctatgaaagataattctccattacttaaattatttaacatccctgaaaataagaaaattactggtgctattatggtgggatatcctaaatatacttatccaagattagttgataaaaatccattagagtttacttttgtaaattagcattgctctataaaatcaagataaatatttgaatattttacattaaaacaacccactaaaatctactatctattttagtgggtttcatggtagaaagaaaaatgcaagacaaaatactctttgttgcataagttcaactaaattcaactgtgaatataaaactctatctgaaaagttttactttataaacatgatgacttctttagtcgatcagctcttcttcttaaatgtagatttcagtgctcgttttactacatcaacaaaacttaatgaataaaccatatgatttggatcaacataatttcgaacagtacgaagcactttctttgcttctttagaagaaaaagtatatgttccatttttcttcgttcgaattgcatatcgtggaatccattttcccttaaataatacagatgcaatcacatagtcaacttcttcccaaggaatttgaataaatttacgataatcacgagaattatagaactcaaaacctttgtcacctatcataatcttgccataatctgcaacaccagcaaaagatgttccatcaattgctagatccacctttgtattgagtgactcaaccatcctatctacctcttttctacttatatacacatttatttttattatatattctttacatgcttttatcaattattccaaagtctattaaaagtaacacgattaatattgttaacaaaagcccaggctaaaaagcctaggctaagtaaaaaagtactacattaaaccgatcaagtggaaaacaataccaattatgaacaatccaagaattataagaattggagataccttcctcttaagtaaccacatacaaagaagtgtaattaataatcctacaaatccagggattaatgaatctaagttattttgtaatgttgtaatcttagtatcagttaatgacatacctgatgcttgttgtaatagagcttgcttaacaccttctgctccagcaggaagtttgctccaatcaataaatgcaccatcacttaatttaacagatgatactactggtgcaaatttaacagatacccatctgttaactaacgatcctaagatgaacataccaaggatagatgctccttttgtaatatcttgtagcatattacctgataaatcttcactaatacgagatcctgctttgtaaccaaactcttgtgtataccacataaatgccatacggatgatattccaagcgaagaagaagataattggtccaaggatgttaccacctagagcaagtgaagcagctaatgctcctaaaattggtcttacagtgaaccagaaaactggatctccaatacctgctaaaggtcccatcataccaatcttaacaccttgaatagttacatcgtcgattggtgcaccatttgcacgttcttcttctaaagctaatgttacaccaacaactggtgaagctacatatgggtgagtgttaaagaactctaagtgacgttctaatgctgcagctctctcttctttagtcttatataattttctgattgctggaatcattgcaaatgcccaaccaccattttgcattctttcatagttccaagaaccttgaaggaaaaatgaacggaaccaaacagaaatacggtctctttttgttaattttaattcttttgacattttcgtttcctctcccttcttagtatctatctattagatcccctaaaggatcaccagtatttgaatttccaccattacctgagccaccttgtttgctaagtgctaagtaaagaagtgctaaagctacacctattgcaccaagtccgataagtgtaatttgtgaaacagttgctaatacaaaaccaattgcgaagaatggccatacttcttttgtagccatcatgttgattaccattgcataaccaacagctacaaccattccaccaccaattgctaaaccaccagttaaccaagtaggcatagcagcaagtaatgaactaataggacctgcaccgattgctaatactagtgctgctggaatcgcaatacgtataccttgtagacaaatagcagcgatttgccacatatcaatagctctaagatttccttctttagcagcagcatccataaaatgtacgaacgctgtagcaagtgtacgacaaataattgttaataataatcctgcaactgctaaaggaacagcaatagcgattgctgaagcaactcctgcttcaccttgacctccaagaactaaaataattgcagatgcaacagcggctaatgctgcatcaggtgctacagcagcaccaatatttgcccaacctaaggctatcatttgaagagtaccacctaagattaagcatggtagtaaattacctgtaaccaagccaattaatgtacaagcaattatcggttggtgaaattggaattcatctaagataccttctacaccagctaaaaatgctattaaaatgactaatataatttgaactatatttaaagtcatggttattaatcctcctttttctctaaataattagattattttaatttttttaattcttcttgtgcttttttaagtatttcgtccatatttgcttttgaatcatttggtactttacgcacatcaaaagtaagtccagcttgtttaagcttattgaatatatcaatatcttcttgattgaaagctaaaactttgcttggttgaaccttacctggagaatgagccattgaaccaacattgattatctttagcggtattccccttctacagctctaagcacatcttttggattttcaaaaagaagcattgcacgttggcctccaaaatgcttatcatcttttgcaagtttaatcatatgatcaactggaacaacatgagccttaacccccggaggagaagcttgcgtaatcaaattcttacgaagagtatctctagctacatcatctgacacgacaataattcgtgtaggatttacagtttttgtccaagcagttgctacttgaccatgaagtaaacgagagtcgatacgagctaaaacgtattcaaacgatccaggtgcacctgcattagattgccctgctcccgctcctgaagcattaccagtatctgctggttctaactcctcgggtttaactttaactccttctttacctgcatttaagatataagctgcaatttcatgagcagattccattgaaagacgtgcaccataagtttcaatcagcattggtaaattcaaaccagctacgattgcccatttatctttatgttcttcaaatagcatattcgcttggttgaatggtgtaccaccccaaagatcaactaagaataaaacctcatcttggttgtcaaaggatgcgattgcatctttcatttttgctctaagatcatcaggtccttcgctaggcatcaacgtaacagcttttacgttttcttgttctccgaaaatcatcgcaccagattgcatgatgcctttagcaaattctccgtgactagcaagaataattcctaccatttttatacctcctattttttatttgttacaaaaacaaaaggcataagcatttggaaataaaacaatagtatatattcgtatatcgtcacaatatttgtacaccaaaattaaatcataaaaaaatatgataataccctataaaaactgtacaaaatatgtgtttttaacgaataaatattacttcattttacttctctatgcttatgcctgatcgaatcagtaacatgctagatattattattatttcattatagtctactaaaagtccctctctaagaacctctctagactacgttttcatattaacacttttcttttagttatgcaatacattttttaatatttttaactaactttcataaaataatttttatactataaatttcccacttttataaaaaacatattctattcaaactcgctttatattagaaattccttaaccattttaaaacatcaaaagaacaaaatgaaataatatattcaaattaacatacacactattcataaaggatgagagaagtctagataataattatttatttatattcaaactgtttatattattttttatgccaaatagaaacctaatttcaagaattctataaaccacttcggatataataattgttaccacaaaaggcaatatcaatacaaatatatagttgaaaattattggaagtttaataataataaatttatttcccacaaaataaaaacctacgaaaatccgaattccagattttcgtaggtttcatgttgatataggagaactacctttataatgcccatcttaaagacacataaaattgcctaactaattagtgaatatactctagaccactcttacttttcttcgcatcctattgtacagtttatgtagaagcttttagattttttaatattttataaatactctatttataattgctgctatacttagtaataacttctttaagtttcataacttcaattggtttactaatatagtcatccattcctgtattaatacatatatctctatctcctcccattgcatatgctgtcattgcgattatagtaatatgtttaccagttaacttttctttttcccgaattatttttgtaagttcaattccgctcatatctggcatctgaatatccataagaattatatcaaaatcctcattttcaagtatgttcaatgcttctaatccatttgaagctatttttattttccaccctgcaatcttacataattgattcataaatcgctggctgataatatcatcttcaacttgtaatatcctagtttctaaataagccttgttatctatacacattttttgaatatttgatgattccttactatcactagcaatattaaacaaacaagtaaagtagaatgtacttcctttaccatactgactttcaacagatatttctcccccataagctcaacgatatttttagaaatagcaagacccagaccagtcccttgaaatttttttgaagctgatatatctaattgtgtaaaataattaaataatctcggaatgtcttcttccttaattccaatccctgtatcttttacagaaaacattagcttcactttattctctttatcctcaactttatctacggatacttgaattttacctttttcagtaaacttaattgcatttcctattaaattgcttaaaacttgcattaatctacccttatctaatatgatttcattcggtaaattattgtcaacaataatctcaagcttcagtcctttattctccgctaaatatgtaaataaatttctactttcattcattaaattaaatatatttatgcgttctggctttagttcgatcttgcctacatccattactgagagatcaagtatatcattaataatctgaagaagatgttttgaagaagtttcaatcatttttactatgtcaatttgctcatctgtcaactttgaaaattccaataagctagtcattcccataatcccattcataggtgtccttatttcatgactcatatttgctaaaaactgacttttagctgagtttgctctttctgcttcctcttttgcagctttaagcttagtctcagttaacttatgctcttcgatttcttcttctaacatacagtttgtttcttcgaggcttccattaacctccaacagttgagaagtacgtttatcaacaagaacctcaagctcattattcaatgaaagaagttcttcatttgtatcaattaatttctcataaatctttgaattaaaaagcattattcctagaattatcatgattgtttttgataaatctaaataactttccatataattaggaaacataatatcttccacttccatataacccattaattcattattaaaagttatcttaaaaataaatcctgctcctgaggcagtaagaaaataactttgcctaaattctgagttgtcgatatcatatagttcacttttatacaacttctcttgattgaaaattatttctccttttttatgttcaattacaggaagaaatgcgagatgcttagcaccggtcaacatttcaaataaagtaaaaatattcttaatcaggtcttcacgttttaaaagtgttgcttttttttcaagaaaatcaaatacaagagcataatcagtgacctgcttgttttttaaatttaaaatgtattctagtctattaactttccaatttttatatgaattatttataatgcttgaaaagtactccaaacctacatctataatttcatatttcattcctatatattctgaaaactctattaaatcagtcatgatattgctatatacgccactgtcaataagaaccacctttttacagtattctgaaaaaaattcacgtgcagtttcttgattaaatccatatatgtccataataatatgcttccatctttttagccaacctggtgtagtcaaataataccccattaaagaaaggtaatttatcagatcacccccagccaataatgacaggcatgaattgaaaatactttcaccaacaagattctcatcttttccagagcccttctgagttggaagcaaaataactgagtcaccacaataacctgattcaataaggccatcgtataatttctgtctttgacgattgcaatttatacaatccattgaatagtatttaaattcaatctctccatttttcaaaacgcctcgcatactctccacttcagctttgaaactttcacaaattaaaatacatagtttatcgttcatataatcacctccaatttaatggatatcttccccacttatttacactctctgatatttcataaagaatgtcctcactaacctgataaggaatgtctcctaaactgtcgcacaagatgaaaccaccaccaactccagcttttcttattgcttccttaacattatattcagcatcaaatctggtccatctgcacatttcaataccatttagatttccaagcaatgtagctctttgaccaacttttttctttatttcagctagatcatcagtatggcttaccagaatggctttaatcccagattcaaggatttcctcaagtattgaggaagagcttgccgaggacgtagcaatggctacatcacttttaatagtgggtattgttctctttgcagaaagaaatccagtctttaaatatatgcttttaggaataattgaagacacagacatagaatctatagtcgttataaaggatgcgcctgccgccaattgcatattagcccactcagtgcaaaacctttcattgatttttataagatgctccaacaactctggtttttcataaataagttcaatatatttatcaaaacccatttgaagaataggaagtgaaaaaggtgataacacgcctccagcaataggtacagacatccccacttcctccttcagtatggatattgtttcaagacaatttctaagaatttttgaatttttaacatctggtggttgtaattttaaaatatcgtcaaagttttttattattggttcaccagcattaggaggccctgcttcattgaaaataacttcacttccaaaagctgcatactcatgggcagcagaataaaatggattcaaacaatcattgttgaattttctgagaagcatcatttgtccctttgctacattctcaggtttactaaaatagtttttaattgatatatctaaaaattttgcgcagtaatgtgtacacattaaaaacaatggaaccttgtctggttcatgcttactcatagttgtcaacactctttccatagaagtatgccttttttccattaagaatcctccttcatccattgttctataatagcaatattatcggctgcgcttttccccattttatctgcacccacctcttcccaaagagtgctgtccattaaaaaaggtgcccccccaaccaatattttaattgaaggatccttttcatgaagcatttgagatattttcttaatttttaaagcagatggatacattaagactgatatcataagtatttttatactatcatcagtgactctctttattatctcctcaggtccacttatagaaccatagtctataaggtcaaaaccgcttgacctcacaacggcacttacaattttctttccaagagtgtgatattcctcaagagtcactattgcaatcggctttgcattcttaattgtgaaatttttttcctccaaaatagaacttgcaatttcctcacaaagcctgctgctcatatatatctgtgataaagctacttctcctctttcccacttttccccgatggaagtcaaggacttaactatatactcatcaataaaatcaatcccatttttttcagctaaaaaatgttgaagaattttattaacttctaacttatcgtaactaattaaagccttttcaaacgcctcccaattcatcatttagctcccttcttcattaagtaaactttttaatttcacttaatattttcttgttaatttacaccatagttttatgttaagaaatatttatgtctaaataatttaaaatttttatatgaatgttagtgtattctccactcagttatgttaaagagtaattgaattattaataaaactattatactctttattattatattttaacattatttgcatataagttcccattaattagaacttaaatttcttacccccactcttggtactatttaaatatcaacttaaatctcattagttatgagtaaaagttttattgaactcatcaaacaaattagttgcacaagaaactaatttatgttattgtaatattagttgcaaaggaaactaatattcaaaggagagaacatttatggaaaaaaatatacaaaaggataaggttctttggacaaaaaacttcgtaattatcaacgttataaacttattaatattttttggatttcaaatgttattacctacacttccactgtatgctaaaaaacttggagggacaaactctatcattggattagtaactggagcatttgtagtatcttcagtaataattaggccaatctctggattacttcttgataagttaggccgacaaaaggtgtttttagttggattatttatatttattatatcagtattttcttattcaatagttccatttattagtgcaattattatgatacggtttatccatggctttggctggggggcagtaagtacagcttctaatacaattgcttcggataatatcccaaatgatcgttttggagaaggaatgggatattttagtctgacaagtagtttagctatggcaatagctcctacaattggactatttgtgatatcaaaatatagctttcaagctctatttttaacatctactatactagccgtgcttgggggtattattgcttttaaattagaatataaaaaaattgaaaataaagagcaaactaaaataaaagcttcattgtatgaaaaaatatctataaatccttctattatagtattttttgtgacaataacttatggtgcattaaccagtttcttacctctttatgcttcacaaaaaggcatagagaacattggaattttctttacagtctatgcaatatccttatttatatctagaccaatattcggtaaaataatagataaattaggttttgactatgcaattattccaggttttatatgtgtaattatatctatgttgctgttatctgagtcttcaaatattagcatgtttttaatcgccgcatttatttacggaataggctttggtgcaactcaatctactttacagacaatggccatggttggagttccaccttcacgtctaggtgctgccaatgctacatttttcactgcatttgattgtggtataggattaggtgcagtaattttaggagtagtttcatcaaacgttggatatgctcaaatgtatctgtgggcaagtggggctgctattatagcatttattctttatttcattattggcagaaagagaaaatctcaattacaagtaaaaaagtagtattttaccttaggattagtgcgtaacacaaattctcaaaacatatattaatcacatacaaagttagctctgcgttttatcaatggcagagttttctttttccaaataatataatctatattttaaaataccaattcataatttcaaaaaatatatatcctagtaaatcattgaaactataattatttatatatataatttaagatggttttatccgatagctagcatccgtagcacgcccttttctttaagcgggagataacggctgcacgcttctggacaatgtgccccttgagggtataagttcaactaaattcagctggagttaaaactccacctgaaaagtttcactttataggaaactaatctaaaggagataagtaactatggaaaacattagtaaacttaatgcagcaatttatagaaatgctcaaagcataataaattcaaagcttatagatttaaatattagaagtggccaacatgattttttatatgtgatttcaaaaaatgaaggtataagtcagaaagagttaagtgagtttctgtatgtaggtaaatcaactactgcaaaagcagtaaaaaatctagtagaaaatgattatgtaaaaagaattcaagatgaaaatgataagcgtatttataggttatatttaacggatgcaggaaaaaaagttatacctaaaatagatgcaacctttttagaattagttgctattttttctaaaagcttatctaagaaagaagaagaacaaacagtcattattctaaagagaatcctacatacgatttctgaagaaaaacataaaattaattctgatattgattaatttatagattgtttcatcttttagaaaatatataagactaagccgccagtatcaaaaaaacacgaccacctgcaaccagctatttaagccacatgcaaatggtcgtggggttcataaataatatcaatgaacatttcacttggggagaattattttactataaaacttgttctgttctttcaattatatcatcttgagtttgtttcgataatacattaaagaaagcactatatcctgctactctaacaattaggtctctatgctcttctggatgtttttgcgcatcaagtaaagtatctcttgatactacattgtattgtacatgaaaaccttctaaacgattaaagaaagttctaattaataaaattaacttttctctatcactttccttagataacatttgtggtgttaccttttgatttaataatactccaccagtaatatcgtgtgttggtaattttgaaactgatttaaatactgctgtaggaccatttttatccattgcatgagatggtgaacacccttcagctaaaggctctccagcctttcttccatctggagttgccaaagttcctgctccttgtggtacattagctgaaattgaagaagttccagcataatagcatcctccaattggtcctctaccatatctagtatttttgtatttctttatctcatcaatatagatttcataagcttctcttaataataaatctatataatcatcgtcattaccgtacttaggagcatcattaagtaatatatcttgaattcttttaccatcttctccttcaaaattattaagcaatgcatcccaaacttgtgcttgggtaaaactcttatcttcaaatacacattttttaattgctgcaagagaatctccaaggttagcaatacctacttgtagatcactgataaagtcatatacggctccaccttcttttaagtttaaacctctttcaatgcaatcatcagttaaagctgagcataatacatctgctgtaacttcttctattgctaagtctgcacaactatctattattacactatgtcttgtaaattcacgaattatcttatcccaggctttcataacctcatcaaaggttgtcatatccttaaagtgacctacaccctcgcaaagcttagttcctgactcgggatcaactccatcatttaaagctattaataatgatttagggaaatttaaaaagctcattccagtacatctataaccccatttacctgggactgctacttctacacatccaattgcactatagttataggcatctttttcatctacacctttttctatgaatgatggaataataacttcatcactattaaaggctggcattccgaatcctaatcttactacttctatgcattctttcatgaaatcatcagataatcctttatggtaacgtactgttaagttaggttgtggtaattttgtctgagcaacactctttagaattaagtagcttaatggatttacttcatcttttttatctacagtctgaccaccaactgtaacattttgatataagggactacctgcactaaaacgtgtatgtgaccagcttcttatcttatttatagtaaaagtcttaagccacaagtttgttaataattcagtagcactatcctcagtaatctttccaagttttaaatctttttcatagaaaggatttaaatattgatccattcttccatatgaaagtgaatgtccatttgactcaatttgcaaaactaagtgaattatccacaaagattgaactgcttcatggaaagtttctgctggataatatggaactttatttaatattcttgacatttcaagtaattcttcttttctatttacatcagattctttttcagctaattctaatgctaaatctgcataacgctttgcaaaagctgctactgcatcaagtacaattaaaattgctctataaaaataagacttatttagattcctatagtctgtaaggtctagttcttttaatttcttttctgttcgctctttgtaattaattaacccaaggtttaatacagtttcataatttaccgctatatgagcatccccagaagtaatattgccctctgcttttataatccctagatcataaaaaattctactttcagcaggcatccctgcaagacctctgtcttttaaagttttatgctcccaaaaaggtgctatttctcttaaaacattcttactttcttcagtaatataaaatatatcaccttcacgtttttcaaattcatcaagttcatttataacccaatccattgcatattcggggaaaataggagctgagcgatttgattctgcttgatttcccgcgattatcgagttatcttcaataaatatagtcatatttttcaatatattttctaaacataacgctctacgtaataccattggcttatcagcgtgttctttgtaactttccgtagtaagtctagctctttctacactaaccatagattttgcatttaataattcttctctaaaattatgcattctatcagttaattctccaaaatgattcataaatattctcccctcattatcaatttcatattataacaaactttttcactttcatttgaaactatttttattttctttcataatcaaattatatacttagattgcattttgtcaacgataatatttcattcgaaagtatttattttatacttgaatctttatataaataataatcttattaaatactttctcttagatgctctctaactaagtgttttgagtttaagtcgttacataaacaactatgatattctaagtaaatctagcacacaattcattatttataattcaaaccagatgtatagttcacttgacatttgatgtaaagcatactatactttaattgtaaagcatactatactatttgaaaggtagtgataagttgcagactagaatacaagagttacgaaaagaaaagaagataactcaaggtgagcttgcagatgcagtaaatgtaacaagacagacaattatatcacttgaaaacggaagatataatgcttccttaatactggcacacaaaattgcacaattttttgagatttctattgaagagatatttatttttgataaggaggatgagaatttatgaaaggaattttagctggtaatacagccaaaactaatgaagaatataaaaatgttataaaatatcgcatgaagattattgttgtacttttgattatcggaatcattacagtagcagttggttttggtgcagaactttatatgaaaacctctgctagtgaaaatatccatgaagtattctccgctgccggtatagaccttattataataagctcaatcctatggattaaaaataggcttttgctcaatgatgaaataaagctgaagaaaagccgtctaaataatacagatgaaagaattcatgaaattggaaataaatcatttaaattagcagccattgtaatgcttatagtgtcatacgcaactgcattaattggaggtctttttgatccactactagctcaagttcttttatttataccttgcatttttttaattgcttatgtaatagcatttaaatactacaataataaaatgtgataactaaaacttacatggtgacttaccgaaatcacaaatattttgtaggtcatttatgtctaaaaatagttacaagccttattaaaaagccttttgatacctcacttatttttccaaattatttataatttgaaatatatgccatacaagaaagagaaggtgctcttttgcgtagcgttgcattgaaaaaatgattgtaggcatttcttcagtaaaagttgttccaaccttgcttgtcacgagctggctcgggatcatgcagggatgggtgcaacctttactggtagaaatccacaattacttttttagcaaccgagtaacagatctccttctctttcggcaagttatcgcatagctttaaatctcaattggtttatcttattctacacttaccatttgaacatccactttttccttctttaaactttctaaaacatcttcaggaatattagtatctgtaaataaatagcttatctcttctgctttaaattgagataccactccacgctcagaaaactttgatgattctgttaatattataattttattagaactttcagccatggcttttaccgtttctgtacgcattaagttttttcctgtaaaccctattttagaattataaccatcagttccgataaacaatttatctacaaaaaaatctttaacgcactttcttgttagagggcctactgatacctgagattccggctggtaatctcctccaagcaacactactttcgcatttccttctctaatatagtttgcaataaatgtagaattagttattactgttatatcctttttattatatgcgagttcttcagcaagtaaggcacaagatgagcccgattcaatcataactgtttcaccatcattaacaagtttacttgccaattgtgctatttttctttttatatcataattaaaagctaatctgctattgatatcatcacttgaagtcataactgcatacccatgttcacgcttcaataatcctttttcttctaatgcaccaagatctttacgtatagtcacttgagatacatttaaaagctctgataatttactgacttctatacgcttgttttcattgacaatttcaagaagctttgtatacctacttgtcatagaaactcctccttctcttaggtatattcaaaaaataactagtcgacatgcctaaatccaatggtaattatatcataaactacttacaaaatgaactatttatatttcgaataaaaggaactctgcttattattgattatatactacttcaaataatattaaacatcaaattattattcttatgaaatatacacttatttcaaatgaaactttttatttacacttatattttttcatgttaacattgaatcatcaattgaaacttaaattattgcggttcaatcataatactaatcttgcttttactatatgggggtgtttttatgaaagatataaaggcttgcattttcaatattcaaaaatacagcatacacgatggtcctggaattagaactgtagtttttttcaagggctgtcccttaagttgcctatggtgttcaaatccagaatctcaagatagtaagatacaaatcatatgtgataaagctaagtgcacacaatgtcttcattgtatagacgtttgtcaaaataatgctatttccttaaatgataatcatataaaaattgattctaacaactgtatttcttgttttgcttgtaaaaattcctgtcctcataaagctctttcagcagaaggtgaatttttaaccctttctcatgttatgaatgaagttatgaaagatgaaatgttttatgaagaatcaaatggtggcgttactttatctggtggtgaagtattaatgcatcatgaatttgcatcacagcttttaaaggttttaaaagaaaaaaatatacacacaacaattgaaactacgggctatacttcaaatgaaatattctcaagttttatagatgatgtagatttattattatttgatataaaacactatgatagagaaaagcattttaaagtaacaaatgtttataatgatctaattattgaaaatttaaaaattgctatagataacggtaaagatgttattattcgtattcctgttattcccaacataaactctagtttagaagatgctaaaggattttgtaaattacttgaatccgttaatgctaagaaaataaacttacttccatttcatcaatttgggcagaaaaaatacgaacttctgaacaaaccatatactttccaaaatgcgcaacaacttcatgaagaagatttattagattataaaaatatatttcttaaaaacggatttgattgttatttttaaaagataaaattaaaaataatatcaatatttttaataaaaatcctgcgtcatttagatataattcacctttgctaattctaaaatacttttctattactactttttaatatgttttttatagtgatgtcattctcttaatatctacaaaccaaaataacccaagacaatactaataaatattgtcttgggctttatagttacagtgcagcgtaacctttaaatttcttatattaaacattcaccgtttgtttctattacttttttataccaataaaaagatttttttctttttctctctaaagttccagttccatcatcttgtttatctacatatacaaatccatatcttttactcatctctccagtggatgctgaaactaaatctatacatccccaagatgtatatcctaatagttcaactccatcttccatggcttctttcatttccatgatatgctgtctaagataatcaatcctgtaatcatcatttattgagccatcctcttctattgtatctttagcacctagtccattttctactataaataaaggcttttcgtacctatcatatagcgtattcatagttattctaagacctaacggatcaatagcccatccccattcactaacttctaaatgaggattttttatggatttaacaacattagcttcggtttgattttccatatccttagatgcacatctagaagcataataactaaaagatataaaatctactgtattttttaatatatccaaatcattttcttccattacaatactaacttctttttccgcaaataccctctttgagtatgatggatacttacctctagcttgtacatctatgaaaaataaattttctctatcctttgtatgagccatccatacatctcttggatcacatgagtacggataaaaatctcctcctgcaagcatacatccaactttattttctggattttgttcatgggctattttagttactaaagcacttgctactaacatatgatgagctgcctgatacttaacctgctctttgttttcaccttctttgaaatatatacctgcccccgaaaaaggactatgtatcaatatatttatttcattaaatgtcagccagtatttaaccaagccatcaaattctttaaagcagcatcttgcataattttcaaaaaatgatatcatttttctactcttccatgatccatatttattaaccagttccattggaacatcaaagtgacataatgttactaatggctctatattatattttttacattctaaaaataaatctttataaaatttaattcctgcttcattaggtttactatcatctccattagggaagattcttgtccatgcgattgaagttctaaaaactttaaatcccatttcagccatcagagcaatatcttctttataatggtgataaaaatcaatcgcctcatgacttggataaaattcattatctttcaaagccaaatcttcttctaaccctaattttactttcattctgtttattccatgtggtataacatctacagtgcttaaaccttttccatcttctctataagcaccttcagcctgatttgctgcaatagctccgccccacagaaattcttctgggaaactgtatttactcattgtctgcccccattatttcaatattatcttctgctggaatatcttcaaatccaaatattagagttaatacgaaagataatacgactgccagtatcattattccaattatccaaataaggcttgatggattttgtggatcaaaaaactgaacacttgtgaacaaacctggtgcagccatagatctacttgcgagtcctgctatccctgctacggcaccacatacaccacctgaaattaatgatgctatcaaaggccttttaaatcttaatgctactccatacagtgctggttctgtgattcccgcaatgattgcagaagaagcagctgcaattgcagtttgtcttaactctttatttttagttttgaaagcaacagctaaagctgatcctcctaatgaaaggttcgcacctatttctgaaggcattaccattccttccattcctgtttctgctatagttgttaatatagttggagtaaatactctatgcattccagtcataacaagtagtggccataaagctcccattattgctactgatacccatcctaatttgctgtgaacaaaataaactaaacctgatattgctgtaccaatccatatacctaaaggtcctataagtccaattgctattggagccgcaatcaatactataatcgctggttttaagaaatttttagttacttctggtgttatcttatctacaaatctttcaatatatgataatatccaagtcatacaaagtgctggtattaccgtatacgtatacttaacagatgcaataggaataaacgctaaagttacttccttaccttctgatgcgcttaccattagtttcataaaatctggatgtaccataagtcctgctattgcaatagctaaataagtattagttttaaatttcttagatgctgatactgccaccataattggaaggaaataaaacgctgcatctcccatagcatttagtaatgtatatgtagtactgtctgctggtagtacttttaacatagataacatcattactactaactttaccattgaaccaccaataattgctggtatcaatggtgacattgtacttactaatgcatccaatatattagttccaacttttttgatagttagcttttctttttttatcccttttgcaatgtcactttgatctccaaagtttcctaattttaaaacttccttataaacataagatacattatttccaataataacttgatgttgcccaccttggtttacatatcccattactccattaatttttttaatctcatctacatttacttttgagtcgtcctttaaacaaactcttaaacgagtcatacaatgagttacactttcaatatttgagataccgcctaaattttttgcaatcgttttcgcaattaatgcataatcctttgccattttattacctcacttatatttattattttcgaatagctattgaatgtatcttaatattaattgaaaaagcttattctgtcactatgtaaaccattataaaaaacatgtctgttttttaataatttgttattgcaaaaaaacaaaatgtttttttgcaattaaaatcgaaatgtgttcttgacatttcatatatttaaaaaactgtgattaacaaacaaaaagagtaattaaaataagctttatcaatttgagttaaaaacttcaaatcaataaagccctatgtaaaatacttttattttttgcgcatagctatttactcatcttgtatagattcttctcgacgattttgtagtttccttccaattctttctattatactgattattggaatttgagttgtaatatcatatattcctactttaacatatggcacataataggggatattataatcagacattttcgctatagtgcaattttcagtattagtaatactaacaatacagcaattatcttttttaaatctatttatatggcctataatatctttcgattctccagacacagaacatactatgacaactgagttttcataaaatttacctgtagtcgggtaatacggatcatcaatgcataaactaaattgtccaacacttgatagatatcttgctccatatcttgctataattcctgacatactacttcctataaaaattgttctctttgcttttaatatagcttttacaatttcctctatcttctcatcatattcttcagtatttgttttcttaaaaaagtcaattatctctgtattatcttcacttacttttttaatttctttttcttctataaataatttaaattttagtttaaactctgaataaccactacaacctacttttttgcagaaatttaatatggttgtagttgatacatgcgattcaactgctaattcccttattttcatatatcggaccttatctttattatccataatataattataaacagaaatttctaaatcattaagacttttgatttgactataactgaacatataatacttccttccattggactattgcatacattatatcaactgataacgtttttttcaatcaagatagatataagtttgagtcaattaaaagttggaaataatttttatcttaagttttcctccagtaaatttttcagcttcattaaaaatttctaatgtattttcagcataatcacctaataagtctttacttttttgaaagtcaacccattcaattgtaactggcaattgaatatcagctgttagacaatcccagagtgcatctaagttttcaccgtaatgagcaggaagctttaattcctgttttaaaatttggtgtaacatatttctatccgtaagcttactgccttgtattactactttattcaagctattcacatccttaaaaaactactttcctttatataataatttgaatgttttataatgatctgaggtagagtaaattaatccatcatttgaataaagaatcctatcatccccacgatgtcctccattatagttaatatcgcattcatgccaaattctattaggcgcatctggtagagatttttcagcattcttaaaaatatctccccctatgcttttaccaggcgctactttgctaagatcgtctcctggcttccatccaagtttattagcctgcgcttttgttataaaattttcaggcaaagttccatttttatgtatataatctgcaacgccttgaaaatcattaataatttttttattctttgaatctccatcttggctggaatctatctttttatcttctgattttgtagcttccacatggttatcctgctgcttattctcagcagttttatttgttgctgcacacccaaataaacctataaacataagtaaaagtataaaaacagcagagattttatgcataaatatttttttcatttttataaccattcctttcacgcttcgctcaatgcacaaaacgcagtgaaattttatttattcttagccttgagcgaatttattttatattcattatccgtagtgatagcagctgactacaaatcatatggaggcgagtgggctacacccatttatatgaataagcactttatcaaaccaaattgtatcagccgtaaaatggaataatcctgaaaattctttttccatatgtatctccgtcccataaattcttttgtaccatcatactacttttattatatctaatatttcttgtttcttctataattttacacatgaataataaaatctactattcatctatatattctgtaaatcatagaatttatttataaattcacccaaaatataatttttcacaaaataaaagacccacgaaaatccataattgatatgctccctttatagtagacagttaaaataataaaactgtttctataaagggggtattttaatgtcaagaaaaatgaaatgttctttagaagagaaagtgaaaggaattacagaatatctattaggagaaaaagcagttgtacagatatgcgatgagttggtaattcatagtgccactttttatgactggttaaaaatatataatgatgttggtgaagcaaatttaatagtttctacaaaaaacaaatattattctgattcgcttaaacttatatctagctggaaaaggctctttaagaaatatatgctgcacatatgaaatttcatctcctcgtgttctcagagattggattaagaagtataatggtcataaaacaattaaatctcataataagcaaggggatagaattatgactaatggaagaaagactacttatgaagaaagaattgagattgttgcattctgcatttcgaataatgatgattatcaagctactgctgataaatttaatgtttcttatcaacaagtttatacctgggtaagaaaatacaaagctaatggatatgaagagctaatagaccgtcgcggtaagcgtaaagatactgatgagattactgagtctgataaattatccgcacaattaaaacttattgaagcagaaaatagacgtttaaagatggagattgatttcttaaaaaaattgaaggaagtagaaagaaggcgataagcactaaaagactccaagaatataaatatatttctataaaagaattacataaaaaaaatggctatccaatagctgatctatgcaatttagctgggattgcacgatcgtcttactacaaatggattaaccgttcagagactgaattagataaggaaaattcaataatactaaaagagattgttaagctttatgaagatgtaaatggtatctatggataccgtcggataacaatgaatataaatagacttctggataaacagtataatcataaacgaatttatagattaatgaaatctattaacatgagatcagttataagaaaaaagagaaagcattatattcaaagtactccacaaattacagcagaaaacaaattaaatagagaattttatgcaaagaaaccaaatgaaaaatggttaacagatgttactgaatttaaactacttaatggtaaaaaggcttaccttagcgcaatatttgatttagctgataagagcattgtttcttatgttgttggtcactcaaataacaatcagcttgtttttgatacatttgatttagcagtaagtgctaatccgactgcaaagccactgtttcatagtgacagaggatttcaggtgcgacaagaagtcgcgtaatacattgtcgttagactgccccatccattcggggtaactctatcgtgactagcgtgaatggtaacgtttgggttagaaagctcacgagacaatgtggaagttcgagtagcctaaactggaacaactgctagagtaagaatgctatggagaacgtaaagtgaatcattgtaggaatcgttacgctggagaaagcgaaataggctgaaacgctttgaccaaaatggtaaggagctgagcaaaggccaactgttaaaccaatgcgaatggataaagaactcccggtttaaagatgactcctaaggcatttacaattatgtattacgtggaacttggtaaaccctatatgttccttcagtgagaggtatctaaccgcaaggggcgaaaagacatagagggcagaagaaaaggataaaaagcgaatgctgattttgtaatggaaacagataaaggttcaaaatttgccttaactcgaaagagtgcagacttatcctatggtatttcttagcaagaaaggattatatatttatgaattttagtaattcaacgacggttaaaaccgagagactaaaagacacgaaatcacttgaatttcaatgggaaacaattgactggaagcaagttgaactcgatgttaatagactacaaacccgaatcgctaaggcaacaaaaaaatggagacaataataaagccaaaagattacaatacttattaacccactctttttcagctaaggcttatgctgtaagaaaagtaacaacaaataaaaggaagaatacatctggagtagacaaaaaactatggtatacctctgcctcgaagatgaaagctgtgctttcacttactgacaaaaactataaagcaaaacctttaaaacgagtatatatcgaaaagaaaggtaagaagcagaaacgtccattaggtataccaacaatgtatgatagagcaatgcaaacattatatgcattagcgcttgagccaattgcagaaacaaaaggtgattccatttcctttggattccgccgtggacgaagtgcaaaagatgcctgtgagcagatattttgtgtattagctagaaaatgttctccaacatggatacttgaaggtgatattaaaggttgttttgataatattaaccatgaatggttacaaaacaatataccaatggataaaattattatgaagcagttcctaaaatcaggatatatatatgaagaaaagctgtttccaacggaaacaggttcgccacaaggcggtgcaatctcaagtatatatgcaaatatgacattagatggactcgaaaaagtgattcaagataaatatcatagaaattcaaaaggtaaaatagaaaatcattacagagccaaaactaaagtgaacttgattcggtatgctgatgactttgttattactgcaaactcaaaagaaattgctgaagaacttaaaactacggttagtcaattcctccaatcaagaggtctagcactatcagaagaaaagactgcaattacacatatagataaagggtttgactttcttggctggacatttaagaaatacagggggaaattaatagtgaaaccttctaaaaattcaattaaaaacataattaggaaatgttcaacaataatccttaaggagggtaaagctagcacccaatctgacctaataagaaggcttaatcaagtcgtaagaggttggacaaattaccacaaacatgttgtttttcaaatattaacaacaccctttatcagttactacagcaatgggcaaaacatagacatcccaataagaacaaatggtggagattaaataaatactggcatgaaaaaggttggaaaagatggcttttcaagacggattaaaatagtcagacatccaaaattgcaggttacaaaaacacctttcttagacaaggactattttgataaaagaaagataaaactgcatatatttgttgccgcctgaaagggtgaagaaatgcttgagccgtatgagcgggaaactctcacgtacggttcttagatgagggaaagggagcaatccctttttcttaatcgattatactaataggactttcaaagctaaacttgataaaatcaaagcaactcaaagcatgtcacgtgtcagcagatgtatcgacaacggaccaatggaaggtttttggggaactctaaaatgtgaaatgtactatttgcaaaaattttatacatatgaagaattgagacaagcgattgatgaatacatagttttctataatacaaaaagactacagaaaaacttaaaaggtctgactccaattgaatatcgaaatcagaccttggtttcataattttttgttttttcatctgtctacttgacagggggcagttcaattttaaaatatcacaatattcttaaatatagctgtgtttttcacatactattattagatttatttacttattttatattccttaaaattgttatatgaaatttttccaattaattttatataattacaaaccttactttccttgagataagtaaattagaatattattttttatatatttacttccattaatactaatgaattcatcattatatctctaaagatacaaaactagtattgtgacttatattacagttaacactgcaaaaaactaataatttaatgtatttcatagatttacctctataaatttaaaaaatcactctgaattacaatacaatatctttctcaatcataagattcaccaaaaaatttttatacttgttcagcaatataataaagcaacttctcggtcgcttcccaacctaaacaagaatcagtaattgatttaccgtatatatgatcatcaattttttgacatccttcttctatatagctttcaaccataacacctttaactaaattttttatatcacaattatactttcttgtattaagtacttcttgtactattcgaggttgttctgaaaaaattttcattgaattagcatgatttgcatcaacaattactgcaggatatggaaaatcatatttattataagcctcagcaactctcattaaatcctcatagtgataattaggtatatttttaccatgctgattaactgaaccacgcataattacatgagcatatggattaccagttgtattcacctcattatatctgtataagaaattatgttttgaatgtgctgcttggattgaattgaacattactgatatatcaccacttgttggatttttcatcccaacaggaatatcaacaccactagcagttaatctatgctgttgattttcaacacttctcgctccaactgttgtataagttaataaatcatcataatacatatgattcgaaggatacagcatttcatcagcagatgtaagatgcgactcttttattgaacgaataaacatttttctaatagaaattagtccatcaaaaatattaggtgatttttctggattcggttgatgaaacatccctttatatccattacctgtagtcctaggcttatttgtatatattctaggaataataaaaagtttatccttaacttcttcatttacttttgccaatctgttaacatactcacaaacagaattctcatcgtctgccgaacacggtcctatgataacaatgaatttattgctttttccagcaagtatttctttaacttctgcatctctttcactcttaatctcttttagattattttccaggggaattaattttttaatttcctctggagatggtatttttcttacacatagaaaactcattataaaaatccccttaccaactgtgttattacattgtaatccttatttccaattgttttaagcgttataaaattttattgaatttatttttggatgttcatcaaagaaacaataacaattatacttctgtctgatatacactaaccactttcttataaataacatcaataaaaaaatttaatattcacaccaactacagttcagtcatatagtctatacttagaacttatgcactttaatcgaataattagatacctgaatcactaaaatttaaactttttaactggctcacaaatttataaaccaatgtataattcactctagagttatattttaactaatataaggacaaattttttaaagtactttattcaatgacttagtattaataattaacgtacaataatattaaattaaaaaggatattatctgcaagaaggctctaacttatagcaaattttcttactcatttccatgcatagttaatattcaaaacacttctcaaaaaaatttactaaggataatctttttataacttataaattttaacagtaatatgtaagttaacttagtatcattgctcaatattgtttaatacaagtttagagtagaatacgaaaaatctaaatttaaattataatcatttatctacataacttttttgcaaaacagtttctgctaatactagcactgaattctctttatcagcaattttgtgtgaatatacaattaacttattctcaatattctttgtaaaacttaacgttattatatcactatagttcgcagactttttataactaattcttaattttgttatcttatagtcttttactatgtcctctgatatagtatcgagtatccaatataaatactttacattattaacatgtccattagtatctatgtcacaatatccaacattcaattttttagtattaattaaattttttgatatattaatttttttcatagtattaattttattttcacttgcttttaatccatatacctcaaacatatcctcaaatttatttctacacggtattttttgcttcatatccaacaaaatccataatgaaaaagcatctgctactttctttcctctcgaattaaatatttcaaattgtatattcataagagattttctatatgcaataggagtcattcttacttttattttttcattataggtcggatactcgtacatatttatttcccatttatttaccatccacgttaaatttatactattaagatatcgtattcctcttcctaaattttcggacatatgcacaaatgtatcttgaaacaaattcattacactcgtaaacattaattgccaatttaaatcaatatcataataatttatttcatattctttatcaattgataacattaatcttattcctcctttcccccttcaatatatgtttcccactaatttcattatgatattcttcctaaaatttaaagtatttataatcaattcattttatattcatataaaataattatctttaaaaattagaacatgtctaaaaacaatatcgttctatactttttacaaaataaaatagaagcaacataaacaaaagtaatatagaagcaaatttcatatagagttaaaacttttcggaaacaatttaatttaattaattccattaaatatatttttttgtatcccaagcatccactatgccacggattttgtatattgaactttagcagaattatgcaacatgttttccatgaataaaattgatttaataattcatttacatagtttgcatctaaaactttattactgaattcagttaaaaattagaaatgcgtcacgtgactaatattaatgcttttaagagttatatccttactttgttttctattattatacaatctttaagtgtatgttcgaaatttaactaattttaaattaaatgatcgatttccataatcatatctgaggttgcagctttatttaattcttctcttctttttctgttaaatggatgacatatccattcaagatccgtctttttaaatctttcatctttacatccacatactgataacgtcatgcccatactaatacatatttctcgtatgcgagtcagtcttttcatcttttcgtcaaatggtatagagtaaagttcttgttgtgaaattgtaggtgttttttcagtaaaagctttagtggcaattcgtgtgaaatcatttctttcccacgaatttttcatattccgagttaaaatcatataccctgcaacaacttcttttacacctaaactatttacatctcttagaatttccgttatattctcttctttatcatcaatatccggtaataaagggtccattctaacaaccagggatgccagtccatctattttagatagtttttcaaggtttttaagtctttccttatatgttggtgctcctggttcaataattttgtttcttctatcatcacagctggacacatcaacctgtacattcattaaatcaggtcttaatttaattacatcaattattgaatcgtcgaatataccttttgaaataaacaatacatttacattatgttcaaataacttttttaatactatttttgttgaatttttaatttcatcatttccaagaggatctgatgaatagcacaaatatacagaaggcggaaactttgtccttttaagaaacttatccaattttaagggtaaaacatcgcccttataattcggattttgcaatttataaactcttagttctaatggtgaaaacaaacaatatatacaatgatgtggacatccaagagatagatccattacatatcctttacatgcattaggttcatatctaatatctgcttgtaaatcttttgaaattccccaattaactattttaacttcttccattttttatcttcctctctataatttaaaatactctttacgtagattatcatcattgtaaaaagaaacagtatttgtttagatttaattaattcaattatatagtcataaatattgacttaaacgcatatacttttctgcaaagtcatgttactatgaatgtcctcaataactctggtaactccccttccatgtctactatatattttaaaaaacttatattaacaaaatatactatgaaagttcatctatgaaatcacataaagattgaactgtaatgcctctatctccagcgttaaataagtaaatcaagaatttatcaatatcgatatcttcttccacatcactttccgtacttgtaagtttttctcttatttttagtagtacatccattatttctattgaatcaagtgccaaatcttcagttattgatgtctcaaaagtaacatctcctaccatcttatcgggtacaacatcttttaaactcacattaataatgctcaatttttctattattgtatatagttttttagtatccatatttctcctcctaaattaatataaaacattttaactctataaaaatataacttttattataactattaatatttaaaaaactcaccttaagttttacaatcatattttaaaattattgttcatattttgcataatcattttttttactacttaatgttattacttttttgaaaacctctttatcattaatatggaaatatatgtttcgttttaaatactccgattcatatttcaagtcaccttcaaaataatgccccgggtaaatcaaaacattttttttagcaatttctttaattttttttatactttcaaacatttcattataatccccacctttacaagtgcatatgccgcaacctcgtatgaatatcgtatctcctgtaaataacttgttttcaagtttaaaacacatgcctccagctgtatgacctggcgttaacacacagtccatttttaatttgccaatacttattttatctgaatcatttaccggattcagatttttacatctaaatccataatagttgatctctttcttagccatataaacttgacaattaaaaattttcaataatggttccactaaatttgtatggtcataatgagaatgggttaataaaattgagcttagggatacaccatttgtattaagatttgccactattttttctaaatcccatgctggatcaataattacggcttcttttatatcattattaataattatatatgtacaattattaatacttccaacctttaattgatttatactatacatagtatccaaattaaaaatcccccttagtcactcatcattaaatatacttctaaaaccttcaatatcaaaaaataatcccaacccctttggatgcactaaggtaaatatatattttcctgaaattatggatatagctttatattgtgaaaaatttttaaaaaaacttactatatagttagaattaaaatttaatttatctatttcataaattttaaatggagaagatataccggtcattaatatctttgataaactttcctttattgtccataacaacaccggatctagtttatgcatatatattaattctttttcatctatagtaagctgggtttctgcaactctattgtttctatcacttataatctctaaatcaactcccattggataaccttgtggaaatgcaaccgcaacaccatattctgaacaatgagttatcgtgactcgaatattttgattgctaggtttcaagataataggttggttgaaaattcctttgccaattaatatttcattaagtcttggttgatgtataaattcagaaatagccttctttgctacataccttcctaaaagataatttttcatacttttcccataatttaatgaattatagatttcttcctcagacggatgaatacatttttctgtatatctatagctgtaatcacttgaaaacttgtacacacataaacttgctttaattatttcgcatccgcgattaaataccatctcattaacatattcatctctaatcataatttaaaatatccttcttattaagtatcattaagataaaatcttctgaattgtctcgtcaaaatcacctttcataaattgctgcgaaagtatatatcttttcattttaccgctcacagtaacaggaattttcttaatcggaatgacatgactaatacctatacctattttcttaattacatgacgttttattcctaatgaaatgtcattgaacatttctacatcaccatcatattccaaaaaacaaataacttgatcttgtttcattttatgattgtatacgccacatactgcaactctgctaaattttgcatcattaacctgttgacaaatgttttcaatatcgtgagaataataattttctccttttacaaatataacatcttttactcttccggtaagtacaagattaccatctcttaggaaacctaaatctcctgtattataccatccatatttatccattgaatttttagttgcttctggattattgtaataaccagtagaaatcatatcgcctctaagtaaaacagaacctactactcggtccccaaccttttcgccatcatcattaataattttgatttcacaattacctatacatgccccaacttctacaaaacttataacattatcatttttaatatcactttcaattattttttcacctattttaacatgatttctcataacattaacttccctaaattcttgtgggcattttggagtggtcactactaacgtagcttcagacaaaccatatgatggtcgtacagttgtatttttcattccaaaatcatacattttttcattaaattctctacaagtatctggtgaaactggttcagcgccatcaattattatccttaatgcagataaatccatatcaatatctttttcaatcgatatgtatttacatacatgtttaagagcaaaattaggtgctgcagttattgttacattatgttcagacatttttttcacccatagtagcggataggttacaaataaatttgatggcataatataatatttaagtctagccaaaaatggagttatataagtccctataagaccaaaactatgtgttaaaggaagccaacttagataaatatcctcttcagatattttcattgcttttacagcttctcttacactagaaataatatttttgtgtgttataataaccccctttggatcattagttgaaccagatgaaaattgtacaaatgcaatgtctgattcattaggaagaattatttcaacattttcatctaatttctccatttcttcagttattataactttattaataatcccctgaagcttgaaactcaaatcatttttataaataaatttttttaatttttcaaaactgtctatatctgtcgctaaaaatggattttttaaattgttccaaattttaagtaactttagtttatccctttctgattcaaggtatgtatatgggactggtataatcctacctaaaaggcatgcccaaaaaacatgtacaaaatctatattacttttaatctgaaaaacaacctcatctcctggtttaacaccaatgtattgcatgtaatgcaaaatctttaacactcttgattttaaatcttctgatgtaatgttaatttcattatcagcattttcaataaaagtatgagtttcattataattatgcatatccaaaaaagcttcacataaagttttataagtaatattaatcattatcttgacaactcctctatatattaacaacctaatactgttactgtatgttttttacaaatatttatcgattttttattccaagtttacaaatcttattaattattaatatctttaagacttacaactaccttacaattatcttttactatatctttactttctaatactttcttaagatcttctaaaccattaacaacagaagttacaatactatctaattttattcggttagatgcatgcagccttaaaattctatcaaatgcaccacataaatggccacgtgaccccactatgctaatattattagtaatcatatgatcaacagcatctataaaaagtggctcaccgcttcttgctaaaagcacaacttttccatttgcatcaattatattgaatactttatttacattatttaaatcaccagatgtttcaataataacattagcttctttcaaattcttttttagagaatcaagactatcatatacatatttagtccattctcgaagtaaatttctacgaaattcaactggctcaacaacatgcacttgcgatgctccaaatactaacttgcttaacattgcagtatatattccaattggacctcctccaaaaataacaacaacatctccggcttttattttagcattttcacaagcatcataagctacacccattggctcaacgcatgccatagctattaaatcatcttcactttttatataaccagtaacatcatgtgctaaattagaatttacatcaacaacatttcccataactccatcaacttctaaacctattagtttggcattcctgcactggttaaagtctcctcttttacaaacatcacaattattacaaacaagaattgattccaaagtaacatacatacctttttctatttctttaacatttgatccaacatctaaaacaaggccaactccttcatgcccaataatcctaccctcttctggaatttcaacaggaacagaactacatatgtatccagtttcaggattgcttttaagtatatgaatatccgaaccgcaaaccccaacataaagcatctgtatcctaattttatcaggatctaacgttcctaacgttctttcttcaatcataatatgaggattcttataaatttgatttggcattggattttcaactgctttcattggttcttcatcagctttaattaacaatacttttgttttcataaaaacatcctttcaaaattattatattaggcatctcccaagcaccatatcaacataagcaaatttaattacaacttttaatgatatttacaaaactatgtttaatatactggtcaatgtaatccaaccagtatatcatgataatgtatattaattatcagttatttagtcaacatagcattattctgttttccatgagcttctacccacatttttcatttcatttacttttaagaatttttttggtatttgatagttagcaagaaccatcttacaatgatttacaaaagtctcctttgtgacttttttatcactgcaatactcgcaagttaattcagttgtatcgttgtttttagttaaaaaaatatttactttatcaatgcagttgattttttttataactgaagcaaccatttttttatcaaccttcttaccatcaacgactaatatatcatcgcttctacccaataattcaacttctccattttcttttattctacctaaatccccaattttatatagtgtcttatctaattcaacaattccatccttagtcatataagcacctattgttgttggtgaagatacatatacccatggtttatcatctttatcattaataattttaaatttaacacctggtattggctttcctacacttctatagctgtcctctgagcagccaatacataaactaccggtttctgttgaaccatattgctgtaataattttattccaaatctatctttaaaatctttttgtagtccttcttccattggtccccctgatgaaattacatacctcaactcattatttaatgtatatttactagaaatagctaacatttttctataaaagtatgaaactcccaacatcacagtagctttgtttaagttacttagttgtattatatttctgggtaatatgatatcaggaagtattaacttagcatttaccttcatactaagcagcattccggatataaacccaaacgaagtataaataggtactataggcaaaatagagtcattctcatctatatttaaatattttgaatatctagtaatttcagaatcaatctgttcttttgttcttactactaatttaggatttccagttgttgcagaagtcaagtgaattattgaattttccttaatattatttaaaaatggagactttgaacaagtatccgaaatcaaatatacataatgatctgtgcctacactctccaaaactacttttgctccaatattgttattcaataatttaatactatcaattgaaaattctgaagatacaaatataggaataaaccctatttcaacacatgctaaccaatgaatataaactccaatatgagaatttgatttacatataactatatctttatatccaatttttttttgttttaacattaatactattttcctagtatttacatgccaaaaatcatctgaaacaaattcacccttataacttacatcttgcttcattattcctacttcccttttagataatattttatatgagctttttcaaacttaataattcgatttttttgcgttttctatcggatagtcaatactctaacttggttttctattacgcgtttctcctcatcttctaaaaggaaatagtatatattatcaataaaacactttcctttctcagttatcttaaaagcatactcatcttcttctagcaatccttgatttaatagctctttaattttaccttcatatttagcaccaccattttgtgctaattgctgctttgataaaaataacaatttaggaaatcctacaatatttaaattctccaattggttctctgttaatttttttagttgtgaaaatctagtgctgcctccatttatataagaattatatgaattatttctatatttatatccatttataaatccaaaagcgcctgagccaagagcaatacaatcaggaacattatgaattccaccataatatgcagtttccattactaatatatctttatcttttttagtgtagccataagatgctttttgttcgtaacctgcttcctccatcatcttatttacagttgtaattatatccacaagttcttctagattagggaatcctaatttttcatcttcaacccttttctctaaattattacagaaagggtacatttgtccaaaatcaattgcgtctactcctaatcttatagcttctctaatatcgttgaaagttatttcctttacatccccaattttaaaatctgggaatccatacataatatcaatacctgtagttatgttattactttttagctttgataatgtcaaataaacttcatctaatgtggcctttgatttatattggtctcttaatttctgattaaaagtttgtacacctacgcttacttttgaaatattattttcctttatatattcaattacttcatctttatatatcgtagtggcagaaccttcaatatttactattaaatcatctgtaacattgaatttttccttaatagtatttaaaatttcattaaatacatctttaggtaaaatagtcggtgtaccaccaccaatatgaataacgttaactctcaagttttttatatactctttagaagcataattttcaatttcctcaattattctatctttatatttaggaatctcatttgtatttttaactttatcaaatccacaaaaagcacattttgaatcacaaaatggaatatgaacataaatcgaagcttctctaatagttgatttgttatccagttcactaaaaaaggcgttttccttttttaatgtgcttttatcagctaacaagtccatatgtggataataatattggtgcggaagtaaaatcttttcctttatcataattaacctctcttttcaatttttattttacataattacctagtgttaaacttacgaattcaacaactcttttacaatattaattaatttaatatactatttcatatatttcccaaccattgaaacaaatgtatctaattcttttgtgttctctcttacaaggtctttattatctatctctatatcatatttactttcaattgcagttattaactctataaatcttattgaatcaatatatttaagatattcttctgcagtttcctcaactttattatcactctcttcatcatcatgtgacatcgataatttttttatcatttcttcaatttcattctttaaattattattcattttaatctccacctctaaattttatttctaataaatcatctacaaaaattgtataaagaaattgacacataatagactatttaggcccatgttcttttaatattcagttaaaaatgcgtctcctaaatctttagacatttttacaaataaagtaatagtattttatattacgtctctttttgttaaatttaggtatccaatgtatactctgcattatgtaaacactaattataagtatgaactaatacatttataatttttatatcggcttagtttacaatgttgaatttctaaaactaaaagtacgttagcaatctattcttagttataaaatctagctttcatgccaattataagactttattaataacatctattacagctgattcattagtcttaagaaaatcatgtgaaccatcaacaacatatttattacaattatgatttgagaattttttccactcatctattaattcatttggtgcaaaaaaagtatcttccttaccacctatcagtgtaaggttacaattgaatttataaataggatatgaaaagcgatagttgtccatcattttacaatcagatttccaaacacgaaaaaagctttttagatatgctttatttttaagatcttctttagtaatacggctccccctaagccattcttcaattaactcttcttcagatgtattctttaacggtttgtcctttttaggtatattaggcgcaggatgcgcacaaagaatgcaatgagaaggttctcttaaattattatctacgatgcgtttatataattcatataccagaacagtcccaacgcaatatccaaagatagcatagttacaatctttaatttcatcctttacaaaatcaaagatactatcaatcactttatcggtattatcacacaaaggttctttaaaccgtgaacctcgtccaggtaattccactggtgataaaattatatgttcatctagatatttttcccaatgcgtataaaacaatcccgatccacctgcgtaaggtaaaagaagtaattttattgtttcttttttactcattataacctccgttattttatttaaattttctttatccattcaactcctatcttacgtaaagttatttttttaattagtaacatttgtaattttaaatctatgaaggttctatatcaagaagcattttgctcaaaattagcactatattgtattatctgtgttattttacaaattttttcactttttttattttttctaactagtttcattgcattaaaaattagacagtgattcattttgaagaagaagttaaatttatcccaaaatatatacactgaactataaagattaagaaaaaagactataaacatcagatctatgagctcattaaatataattatgatgagactgatgtccatttagtttacagaaaagaaaaaaacatagactatcaagtagtgcaatttttacttagacaaaaaaactctaaagataaaaataaaatgaaaactaaattaggtggaaaagctttaattgaggaaacaaaataatatagaggaattaaaagaagcgactccataaaatgatgactaatgaaaattccggttgaaaagaacttctaaatagctatccttaataaagagttataaaaaaaatttatacatgtaccataaatgccttgagtattggcattttgatgcatgtataaatcaaatctaactataattataactactaagttataaaataaatattatgaaattattgagattatttttttatagcaattgttattccatcatcaaaaggaagaagaatactttccacattacttttctcgcttagtcttctattaaattcgtccactttcttattactatctacaaaatatgcccttctttcaagtgcaggaaaaagtgtatcatctgcaattagaacacctccttgatcgagtgaattaatacaactatccataacatctggataaagattattaaataagtcgagaaataccaaatcaaatttttcttctattttaggtaaaacatcgaatacactatcatttattagagttatattaccaagtacattatatttttcgaaattttcctttgctgctaatgctacttttttatctaattcaatagttgttactgtgcctccccattcagcgatagtttctgctattattgtagttgaatatccaatactagttccaagttctaatacttttttgggtctaatggccttaagtaatatccttaaaaatatagctacagatgtatctattacagggcaaaagaaatctagagatgtgttttttataaattcttctctttttatgatagtataattttgatatagactagaaatataatttttaactgaaattttactcatttaatatcatcctctcatgagggtgttgcacaaagaataaaagccacaatatatagtatttgattttaagcttctaatataacatattgtagtaatatttcttaatgcgacagctccctatatttttattttttatccgtctacatttacattttttcctttttgaacgttcaaataatatttaatactatacagacgcagcaaataattgataatgttgtatagtaattcttcattccacatactaaaacataatacactcaaaagttattgtatctaaatacaactgaatattttataagaaaataacataacttgaaataagttattcaatagaaagatggacattgctaactttttatacattgatgttagtataaaagtgtagccatagactgatagtttttttagaagtattataataaagtaatgataaaaaggaagtgtttacatatatatattgaatacgtaaaaatctcaatattcaatatatttaagattggcataaaataaacacaattcataatagaattatattcatgacttctcaagaatataagaatctttgaaaaaatcaattaaaaaaaacaaaaatgtgcccactataacgacataaatttatatcgttatactatttttaatgtccaatcttcacaattccatatatctgtcacaatatctctgtaaaattcaagttcgtgtgatactaaaagaatgcttcctttatattcttttagtgctcttttcaactcatttttagcatctaaatcaaggtggtttgtaggctcatcaagaatcagtatgtttgtttcattatttaatatcttacataatctgaccttcgcagcttctcctcctgataaaactcttatctgagattctaattgttttgcagttaatccacattttgcaagagcagatcttatttgatgctgagtatatccaggaaattcactccaaatttcttcaatacatgtatttctgttgtcggctctgtcttcctgctcaaaatatcctatatgctgataatctccaagatttacttcaccacttagtggttttactattccaagtaagctcttcaataatgttgacttaccaagaccatttgctccaactaaaactattttctgacctctttccataaacatgtttagtggttttgtaaggggagaagtatatcctattactaaatctttagtttcaaagataactttacctgaagctcttgcaggcttgaaattgaatttaggctttggtttttcagggattaattcaatcttttccattttatctaatctcttttgtcttgatcttgccatgttagaagttgcaagattggctttagttcttgcaacaaaatcttcaagtcttgcgatttccttctgctgcctttcatatgcagcttcaagtttctttttgttttcagaataaattctctgaaattcatcgtagttcccaacataccttgttagttttctttcttcaacatgatatattaaatttactaccgaatttaagaatagtatgtcatgtgaaattaatatgaatgcattttcatatgactgtaaatatttctttaaccattcaatattttcttcatcaagatagttagtaggctcgtcaagaagaaggatatctggattttcaagaagaagctttcctaaaagaattttagttctttgtcctccagataaatcatctacatctctatcaagccctaaatctaaaagcccaagaccttttgctacttcttcaacttttggatctattacgtaaaaatcattgttatcaagaaaatcctgaattacaacagttctttcaagcatcttgtttaattcatctttgctgcagtcacccattttttcatataaagagttcatttcggcttcaaaatcaaaaagatatttaaatgctcctcttaaaactgctcttatactttttcctttagtaagagtaacatgctgatccatatacccaactcttacgttgtttgaccatgttactttaccttcatctggctgaagctttgcagtgactatattcataaacgtggatttaccttcaccattagccccgataagtccaacgtgttctccttttaataatctaaaagaaacatcttcgaatatagctctgtcaccaaagccgtgattcatatgctcaacatgtaaaacactcataaatttcctcctatcttgtataatctagttgtaacatttgatataaaactatttaaaatttcaacaaacaatcctgttttatattaaatctacgaagattttatatcaagaactgtgttgcgtaaaactagtacaattttgcaatatatgatataatttaacaatcattgaatattcatgataatataaaacaatgtatattattagatttaatcaataagaataatattagaaaagaagtgatagcatatatatgaaaaataaggaaaattactattgcgaagatatgcctgatagaaattttagtgtagatataggattgtccaaaatttgggaattaggcactaactttaaagagcattggcatgagcatttacaagttttttactttataaacggaaaaggctttttaagatgtaacacaaaatcttttaatataattcaaggagatgttataataataaacagtagggacttgcattatttggaaagtttaaataatgatttaagattttacttaattcgtattgatctaccgtttctatttagcgatcaagttgatttatgccagacaaaatacttatctccattgtcggaaaatcttattttattcaaaaatttaataagaaatgatgatgaaattgtacgttgtataaagactataattaaagagtataataaaaaagaaattggatatgaacttgctgtaaaagccaacctatataatttagttgttttacttatccgaaattatatagataagtttgtaacaaaaagacaattagcttttaaaattaataatgatgagcgtttttataaagtatttgagtttgtacatagtaattttaataaaaaaatatccacattaaatctttcgaatattgctcatgtgagcccttattacttttgtaggatatttaaacaaattacaggaaaaactacaacagaatatataaatgaagtcagattaaaaaaatcaattgaactattaaaaaatagtaatatgaatataacagaggtcgcaataaattgtggctttaacgatgtaaactacttcagtcgtttattcaaaaaaaaatatggtgtttctccaactaaatttatatactaaaagtttgagtttgggatatgtttgtttacaaaaaaaaggctgcgaactaattgttaaatattcctcgtagagttagcagggagtaaaaataataaacctgtttattatgatgaatagcatatttttatgtttaaaaaactaaagttatatttgaaaataagattaaatccgtaaaatacttgtctatattaagtcagctcctgaagcagttgctggaagcatacttaattgtggatttaatgctgaaagttataatcaaaatgacttacagacattacataatttaaatatggaaacaacgacaaaaacatatttaagtctattttaaatcttagagatcgtcatattgtttcataatgtaataagccatagtaatgataaaatataatgaattttcaaagaaaaatgttgcataaaaatggcactaggtatttcactagtgctataagaaataatttttttcttctgtctatttgacagagttcagttcagttttagtatctacagtctttttctttttgaatactcgaacaatatttaatactatgccaatgcagcaaatcattgataaaattctatagtcatttttcattccatatacgaaggcataatcctttccaaatacatatcctaaaacttgatagtgtaatttttggctcataaataggtatagaatagtagttgacagagaaattccaacaatttgccccaagtttcttactagggaattaacgcttccagctataccaagctgctctttcgggcaatttgacataataagggaattatttgctggctggaataaggattgtcctaaagacattaatgccataaaaattgttgcctccaatataaatgaatattctgtcaaaaaagataaaagaaaaaatgctatactcataagtgttaaacctattaagcataatatctccgatcctattttatcagaaagtgtaccacatataggagaaaaaattgcaagtataataggcgataccattaaaagaaatcctgttttggatggcgatacttccaaagtatattggaagtaaaatggcaataatatagtagatgcagcaatacatgtaaaagaaataaaagcacatattaaatttactgaaaatagtttgtttttaaatatttttaatgcaagtaaaggatgtttgctttttatctcaatatatataaataaaacaattaagattatagacacaattaaagcaaccattatccatttattatcaaaacctgttttttgagctagcataaaggcaccaaaaaacaatgatattcccaaaaattgaagagctgctcctgctatatctaatttttggctatcccttttaattcttggcagatatttaatcccaataataaaaacaataactcctattggaatattaataagaaaaacataatgccaatttaaagctgaggcaattatccctccaactggtggtccaatcatagttcctaaggcaacagcagtagttaaaattcctaatgcttttccacgctcttctcttggaaatatttctgttattatgccgtggttattagccatataagcagctccacctattccttgaataaatctaaatataataagtgaaataaacgaatgggaaactccgcataaaagagagcctaaagtgaacacgacacttccacattgaaagacttttgtttttccaatcatatcacctaatcttccaaagaataaaatagttgaacaaataataatagaatagctcgcaataacccattcaatagatgaaagaggaacttctaaatttttagacattacgggtagtgtaacattaactatacttgaatctaaagtagccataaatgtcatagctactacaacaaataatacaatccacttattatttggatgattattaaatttttgttctttcattataaatccacctttttttgtaatatatgatagctatctaaaacactagtacaactgatatgcaaatctttctcttattttgcttagatacttatgggtggccacttcatttaaagtttattcttcttaatctagttcagtttcactaggtttatatatatataataaatattttaaataatacattcaagaattaatttgctgaattttagcactatatctataaatagtaatctaaagatatttaggtaaataatcgtttaatcatacatgaaaatgacttatattatgtaagaaaatatttattctgaaattgaataccttaaatcagagatagaattatttaaagaatctaatagggttccttacgatgcttcctcttcacgaggattacgcgaacatgtagaaagtttttatcctaaaactcacagattacattcactttgacatgattctattctagtatttatattttttgtatcaaaaatatttcaaatggtactattacaacaatagatagcactggtaaatttatcactcaagcagtagatataagatataatagtttaattgtatgagactatttgatgctataggtagacaactaggtcatttgaaatcaaacattgctaatcctgctggtttatctgctccattcatgggattatttcagaaattacaatttagtaaacaaatcattagaatgatatagaatatttacttttatttacttaaaagttacctataaaatggcttaaaactgttatatttagcttctagaaataacgttaagttaacgagtttaatttatatacagtttattgaagttactttgcacttcatgacacgaatgctacctacaaccctatttaaatggaatcatctgatattgtgttaaataaactgatacagcttttaccttacctccatatcgaacactattagttattccatcagggaatttaccggtattttttcttctacactttggacatttttttacttctgctctatgctcaataattttaacttttacctctggtatatccacaacttggcgaataatgtgtctttccggagatatatcctgtaaggactcgccacaaatatcacatttatctactgcatgtactattatttcatctggattatcactaatctcaagagttttaccttcatgacctttctgaccacctggagttttaccagatttagttcttaaacttttagttttctttttgaaaccatctgacaatggcggtttgatactattattactatttttattaacttgactttctaacgatttgacacgttcatttaaagttttattttccttagaaagttaatctatatttgcactttgttcttttatttgattggataattctttaatcaaacctataacctcagatattcctttgttatagatttcaatgattttgccttcgctcacgaaagttattaccttatcattagtttatacaagttgtgtttataataccaaaaactaatgataatagaaaggttttttagaaattaatgataccacttatattaaaattatttaatagctgaatggctacaaaaataaaaaagtaaaaaattttgtaaaataacacagatattacaatatagtgctaattttgagcaaaatgcttattgatataaaaccttagtagatttaaaattacaaatgttactaattaaaaaaataatacaaagtttttttatggtgtccattgtaataaattaactacgttaacattattataactatatcaccatttattacaagccaaatgtgatactagcatctgtgataccataggcaaagtttttttctcaaaagaaaattaaatttaacatagtattatgttgcattttttgttttgttcttggttgcatatatgctggcattatcaaaatactgcttatgagtactaatattacaagatgagtattaaaatttttagctaacatagcaacgaaggagagatttttatggaaaataattctgttttttgggagtttaaagaaaagtgtttaaatggttattataaaacaccatttcaaataccgccgtcatattgggggttgcatgaatgggacacgttaagtgaagatgaagtaatgaatatgttgtttccttttataaagttccaacttaaacgtgcaaaaaattcgatggaaatttacaagaacgcatataaggacatagatatagatagtataaataacatggatgactttaataataagattcctttattagtaaaagattccactattgagaatataggatttcgtggcaaagttagggaaaatccttacgtcttaagaccaaatgatataaaagatccaatgtacatatataagtccggagggactaagggagttgcaactcctacatttattacaaaaaatgatcttatacgagagtcacactcatttgctagatccttttactatgaagggattagacctggagatgtagctctttcgacttataaccctacacataagggtggcgaagcaattaaagaaggacttatgttgaacggagttacatttattccaagaagaaccaacgagactgcagaagatattataaaggtgataaaggactacaatgttaacgtactactaacagtacaaggggatgtattgaaaggagcacaagaatcaaaagacgcaggagttgactttatgtccttagtagaagctggtcaggacgtgcttgagaaaaatattaaaactctttttttaggtggctataagttgattgatgaggcaaccgcatgggctaatactttcgaaaaacctcttgtaaatgcgtatggagcttgtgaagcattggttcttgcgacaaatactccttcaaatggagtcaatttatgtaaacataataattttcatcttatgtatggacctcatattgttgaaatagtgcgttatgaaaatggaaagttagtacaatgcaaaaaaggtgaaactggtatggtagctattacaacaattgcaagggaagggactatctacatccgttaccttatcggagataaggcaactgttgtcgcagatgagggtgaatgctcttgtggaattaaatcaaaaattatatcaaatttatcaagaatagacaatcctcaggatcttatttcaagtggatgtatgtgtacaatgggttagcaacatacagtaataagtaggaacgccttgtggttaatgtgatgggctttcataagaattatgtaattattatattgaaagtagagaggtatcatttatggatggaaaaatattttacaatttaataggtggaaaggaaatgcttttaagcggaaaaacatacaaagctaccagtgaattttttattgattattcaattcaatgtgctgattcaaatattatggatgttaaaatagctatttcaaaagcgcaaaatgcaatggaagagttacaatcaatgtctgttgaaaataggaagcagattttgatgaagtttattaagttaatttcgtcagatgaagaatttgaaaagcatatcactttaatgtcagggattcccataagttcttcaaggaaccaagcacaggaacttgtaagtttttttaaagatcaaatagatgaattatttgtaaattatgaagtaaagaataataatatttattcacgctttgatccccaaagtatatttacacctaaacaaggaatcgtttatgtaccactgcctttattggcggtgcgggcaataggcatgatattgcctatcagtatattgcttgggatgccgattatagttaaatccaataagataatagtttcttttctatttaagattgctgacatattaaaacaattaggatatccagcagcaggttttaatattatcgattttaatcagatgaatgaaaatgcatcaagtcttaataatgcgttaattaacgcaagtgatgttgtatggacattcggtgatgacaacagtataggatatgagaaaacaaataatcagagtacaggggatgatgtagttttgaaagatttgttttatggtaaaacaataataaaccatccttaccataatcatacggctattgtttgcaatggtggagatatagaacgttctatagatataattgtagagtcttgtatttcatttccgtttgaatgttctcttaaaagtttatacatcgttgaagagtgctatgaagaagttaaacaaaaattaattgaaaaattctttaatctggctgaaaagacaggaaatccgctttatgaaggtaatcaaattggtttttgcgatagagatactaaagaatctgtgaaaaaccgcattattgacttagaaaaaatgggtctgattaatattttagtaggcgtcaaatatgatcaagaacaggaaaatgtcagcttcaaaaatcacaaaatgaatcctttgctattggaaacaaatgacgagttagttgacatattgacagcttcgcctgcagttggaattctaactataatgaaatgtacggatattaatgacggaattgaaaaaataaataaagtattagacaaaaagaggataggagttactttcttaggcaaagacctaaaagaaactctgccggaggaagtaatgcttaaagctaacgctattcacttgaaagtcaacgtaaaaactgtaaaaccggatttaacatgccatgatggacgtttttactttttacttttgactgaattaaagagaattttgcgcagtgaatagggagcatatagaaactcattaaaaaaggaagatgcagatgaaaattgtttcgataattacaatagaaaacacttttatttgcaggaaccaaattttgttacgtaaggattaaaatcttattttgaacaaaataacaaaaatactctctctattatttttcatccagatgcatttaaagaaaaggtagtggataatttaaaagtttgttctcctattttagaagaagaactaaaagaaaaatgcaaactaattggctcaaaagaacctataaaagttagcaaaatctaatttttttaggtgaaataccatataaataattttaagaatataaaaaccattgggtaaacaaattaatgcggatgattatgtaatggatgattcagcacttataataaaagtaagtcgagtagacttacacctcagagtctgtcaagactttcgtgtaaacttcaaaaagtaatatgtttattttataaggttggaggtagaataaaacttctaaccttaattttatatttattcaatattattacattatgtatgtatagattgagtgagttgagttcctgcatttttaaaacaaaacttcgtctaaacgaccttcgaagaagattgataattgagctaaaatttgcgcccagcccttaattccttgcgtccatttctttgttatatcaatagttgcaagataaagtatctttagtaatgactcatcgttagggaaaattgatttacttttagtaactttcctaagttggcggttataactctccattgcatttgttgtatatattatttttcttatttcaggtgggtatttgaaaaatgttgagagttcatcccaattatttctccaactttttattgctattagatatttgcctccccatttttcttctaaattatctaattctgctaacgcgacgtcttctgttggagctttatatactgatttcaaatcagtattaaaggcttttaaatccttataagataaatatttactagaatttcttatttgatgaataatacatctttgtatttcagtattaggaaatactgctttaatagcttctttaaaaccgttgagaccatcaacacatgctattagaatatcatttataccacggtttttaagttcatttaaaactaataaccagtattttggtgattcagaagcaccaatccaaatacccaatacatctttcttaccttcaaggttaactccgataacagcatacgctgctttcgacacaatagcattatcttttcttactttaaaatggattgcatccataaatattattggataaattgattctaatggcctgctttgccactctttaagcattggaataactttatctgttatattagaaataagcgttggtgatgcatccattccataaatatcattaatttgagttgctatatctcttgtggtcattccttttgcatacattccaatcacagcactttctaggtgtgatacatcagtttgatgtttcttaactatcgccggctcaaatgagccttcgcggtctcttggaacatctaaatcaaatagtcctaaatttgatttcatagtctttgtactttttccatttctactatttgaagtgtttttattttcataatcatgtttagcatatcctaagtgactttccatctccgattccagcatttgctgaagtacccctccaaataaatcctttaatgtattttgtatatcttcagtcgtttttatatcagagttactcaaaattaattttactaattcatctctagataaagacatagcctgtgctcccttcatttgataatttattatatcattctaatgaagtttacacagactattttacactctcacacctcacaatgtagcccctcacagaatccgtacatgcggctttcccgcatacggctcctcataataacgttaactaacctctatataaaagctcagactatatatttcatacaaatcatacctgctaattttgctcataaccttaactccttaactatttttgatcaaagcaaaagacacattgaagataacttcaatgtgttctttataaacaatgacttcttttacaaagtctcttatgaactttttgcactcaggaacattcctactaattacatagccgctaaaattacttaacaatcttcttacatctgcttctgttactatttgattaatatctttagcttcaatttctgataacttagcttctaattcactcttgctattcttaagttcatccattttagccttgaactcttcttgaacaaatccatttgttatagcagttactatattactaatttgaccttcaacttcatctatttgttttaataacactaccttcttttcgtcatcagctttattttgcttttgaaggttcttattaataccttctgctatataagtgattgctttatcattaaatatttttctttctaattcaagcaatacatattcttcaatgtactccttacgtatttccttattatcacaaagcttagagcttgtctttttttcaatgacacttataaaatatatacattttttacaattaaattattatatgttgtttttcttataaaattcttttctgtgccatttcatatattttttattctcactattaagacttatattatttaaatccttgcttatttttaaattttcataaatcaccttatctaaactatcatttagtgaaatattaccagcatcatcaaaacttatataaaacttatcaaatagccaatcgtggtctgagcaaagaagaaatgcattgttagtatctcttctctcattatcattagattctgcccatctctgtatatgactggctatcaaaaatctttcatcattcaaaccacaaattttacatttacaatctttctttattaataattcttttaacttaccctgtccaattcttgatttaactagttgttctttttcagtagtacctaaatcttttaaactatttatatccatatcatctaagttatcttctttttctacttctgggttatcttcaatagtttcagcaatttcatctatataaaaaagttttttatatagtgcaacatcttctccaacatatattaactctgcattacctttaatgaatttatcgttaataaatatttcttcttttctaagcaatctccacaaaaccccatcaaatatacattcattatttttaattgaactttcttttatatttatatttaatccactattagtaatctcttctcttgctttttgtaaactaaatagaagaacgtttatattattctccagtatctgggcaatgcaataatatggcaataaatcattctctttacatgcattgtcaaaaccatttatagatgatattttttcataaatagtatcatcttttattttctgcgtttctctatttcttactacaacttttatacctatattttcatttattaaataatcaatattttttatcttggttgacccaaatttacaattactctcacttaatattgcttcaagtatttgttttcctattaattttgtgcttattcccattgagtacctcctagttaactatttacttaaaattagcatacatattgtatatttaaaaattttcgatggtttaattattatgctacccatgacaataaaaaaacacgaccacctgtaagtagctatttaagccacatacaaatggtcgtggattttatggtggaggcgacgggtgtcgaacccgtgtccgaaagtagattgatttatctttctccgagtgcagtctaagttttaaaattccctcaaagtatcgcccttagacaggctatacttctcagtagcttcatgaatacccctctagctcaaagctttgctaggcttcgtttcccactttaatgacaccagtgatccaagccgtaggcaacctgggctgatgaacagctattaaactaagctgctaatgcaaaattatcttctgcgtttacatttagtgcatacttttttaacgaggctccatgcgtccctcgactcgcttaacaaacccttcttacccccgtcgaagccaaaacgcccccaagttaaagatggtttaataacatattttgttttcaaagaaatgttcatcttgtataacctattctaacttaatagatgctaagtgtcaactggtacattgttacttagttagaatcaacaatcaataaatcctgtattataacttaaaatcattaaatacttttattaaaaaattttacaaattttaagttttaaattaataatcaaaggataatatttattataaattttatcctttgatataaatcaataaatcttaatttactttatttctattgcaaccattgtacaatcatcttttaattttccactctctaaaatactatcacttaagaaatcatctaagtaattcttaaattcaaatatgcttgaatccctcatatattcctgtataactttatcctcttctagaataaagtctaatccatcagtaaaaaagaaaattttatctcctgattcaaaaaagatcgtttgctcacagaattcactattatcaaacatacctaggaaagatccttctacaatcttctcttctaaactttctccttttttttgaaaaagaaattgattaattccggctccaactactctaagctcattactattaaaatccatgctaaaacaacatacagcaacataattttcttcgtaatattttactaacttcttatttaaattttttactatctccattggatcatggtgacccttattaacttcttgaaaacacaaaatatcaaatgcagaaatatttagagctgccgatattcccttacctctaacatcaattatcattccaataataaagtcttcgtttatttcataaattctatagaaatccccactaattgtatgggctggcatatacacactcatagtatcaataaatttttgagcaggaaattctttttgaagcgtactcctttgtaactcagcagctttctttatatctcgcttcatttcagtaatatctcttattgctgccaatatggcttggttaccttcgtataatatgtagctatatgaaacttgaacatttattaacttattatttggaacgtagaagtcataatcataaatttctttcatttttcgttcagatattatatttctaaatactttatgcaaagcctttttatatttgtcttcaaaatgtctatatacattactcccaatcaaatcatcataaagcgttgcaaacaaattacaggcttcattattagctaaagcaattttattatctactataataattacagcatcgggtgaattatcaattatttgtttatatcgttccctgctatctttagttatgttatcaagcatttttttctctgttatgtctctaagcctctcaacaataaataataattctccatttttatctaacaccggattatagcatacatccataaatttatttaattctggaatatatctttcacgcgatagcattttcttagtcgccactacttcttcaaaagaacaatctaagcatttttcatttctagatagcacctcataacacatttttccctttatttcttctgaagttttattataaaactcataccctgcttcattaaaaaaagatatggtataatctgtattgtatacttttattacatcaggtattccatttaatattcctttaagctcttcttctaatatcttgtattcagtaatatcagttgcaattactaaagcaaaatctttttcttcatgactaaatagagatatattagatttagcgtaaatacgtttttcatcctttgattttaatgtaagctctattttatcgcatactctcttattacttaaattttcaaatatactaatcttatcttctatattggttaaattcaaaacatttgaaggtaaaattttaataagttcctctctagaataacccaatttactacaaactttattattaaaatctataaaattctttggaacaaatcctttgctaatctcaattacaaacactaactcatttaccttgtcccaaatttctttgtaattactttgacttatttctacgctttcatctaatgtttttatactttctttaccctcacgcatacaatcgaaagtcctttctatctgaatttcacttcataaaaactccagatatttttacggacaaatttcaaataccttatctaaccttgttaatttaaataacttctcaacttctggctttagtccttttaattttatacttccattcttttcagcgcattttttataaacagctactaatgcgccaagtcctgtactatctataaaattacaatcattaaaattgaatataaaattcttttgtccttcatctattaatttatttacttttactctaaaatttgcgacttcatcaacaacaaagtcttttggtatacttatttccatcaattatcacctcatattttaaatctttctacaagcttagttaattcttctgccatagcgcttgtttcctgtgctgtagctgttaaattattaattgcactagcttgttcttctgctgccgaagatacattttcactatttgacgcattgctttctgttactgttgctatatcatttataagcccaattaccttatcagacgatgctacttcatcaccagtaatatcaagtatctcagtgacatgtttaactatattttctattgcattaatgatatctacaaatgctttatctgtttctgatactatttttactccattgtttacttccgacttagatctttccattgctattaccgcattctgtgtttgctttaccatttcactaactagtacagcaatctctcttgccctatcatttgattcttcagataatttacgaacctcatctgcaactacactaaatccctttccatgctcccctgctctagcagcctctatagctgcattcaatgctaaaagattagtctgctctgcaatagaatttattatgtttataataccatttactttactcgataatccacttaaagattctaatgcctgcgaagtttcttcactgcctttacttataatatccattgcctttacagtttcctcaactttttctcttccaagatcagctgctgacattgtattagctgcatttgaacttgtagctttagctctactttgagctaattgaacaagacttgaaagctgaaccaacacttttgaaacatcaactatagattcattttgtttttctgcatcttgcgccacttgattaactgtagcacttatttcttcagttgcagcacttatttcttctgaagaagctgccatttcttctgatgctgcattcaactgttctgctgcgttagttacatttcttactatttgatcttgatgctttatcatttcattgaatgattttccaagttcctcaatttcatctttgctttgtatatcaatcttaacagttaaatctccttctcctgcagatctcattaatctctctagtttcttaattggattaattattcctattgttgaatatgtataagcacatatcattgctataatgattgatattaaagaaataattattgtatagttccttatacttaaagctgctgacatatattcgtcatattgcgctgtgactgcaatcacccaattaccaacaggttggaaaacaacatatttatatatattcccatatgtatagaagccttctgaagattttccttctttcatttcctgaactaaaacttttaaatcttctcctgcattatcatttgcattttcttttaggattttacttgaatctggatgataaacaattaacccagttttatcaatcatatatgcatatccacttttaccaacttttatttgagatgcataacttgatatactatcaaactttatacttcctacaagtgtaccaatcaatttaccattttccttcaatggataagctataaaaatagctggattaccagtaaatctagaagttaatacttcactaacaacttccttaccgctactaagtacttgtttcatataatctctatcacttaaatctatatcattctcttttgactgagtatttacaattaccttaccataagcatctgtaataattaatacttccataaaatctttatttttctcttggaccgctcttatatattcagaagctgtatctagattgcttgtatttgaattttcaactgcttttataatatcgccattcaaacttgcaacttccaaagaatgttttgttgaatctatcgttttatttattaaattagatgtattgtaagtctgttcctttaattgttgttgaacagccgtttgtatagatgcgctggacattctatacgaaatatacccaagtaaccccattggtaaagaaatgagtataaaaaaagtaatcataagttttatctttaaagaaattttcatctaattgcctccctagcatgtacaatattcattaggtatcaattactaaccatatatcaatctatatgtcacataaaagactcttacgcataattatagaacttccgtctaagattagttcatcagtataacaacttataatatacaagcctctacctgattcatctaatatattctcttcgtctattttcttatgcaaatttatattctcaaatccttgcccacaatcttttactataacacttagtaaattatctttcaattcccaatcaacataaattggtttactgctatcactactatttccatgaatatacgcattattaacggcttcaaatattataagtttcacttcaaaagattgttttttcaaatccaaaacctcaatgatatcattaaccttcttatcaagaccatctagtccataaaatatcactgatccttttgttactgacatattaactccccctcttttacatagttaaagtattttttcatgattaactaaaaatcctacttatcttatcatttttcattaatattaactaatttttccaatcaattaaagataaaatatccccattacattattacacttatttcatctgctttcaacatattacatcatatccattggtttttttaatatgctatattgtatgaaatataacatcttcaaaaaataattttcacaatatattttcatgtgaacttcttttaatcaaaaaaacataaagtgataatttattttcaatatcactttatgttttatatgattcaccttctattgtcctagttttattttataactaatcatatcattagtttgtatttttcatttaactcctaaagtctatatcttcttaaagttaataagtattactatatcttaaatttttgtaccatttcattaagtttttgagcaagctctgcttgactttgagctgttaacgctacttgttcaatagcttttgttgtttcattcatactatcttttatcatttcagctccttcacttgatttttgcgatgtttgtgccatattttgaattgcttcactaacttgtccaactgtagctgttatttcttctgacatagcagcaatttcttctgacatgttacttacaaagtttgaatcattatagtacttgttacctacttcactataatcattaaattgttcttctacatttttgcttataaactccaatatatcactacctgtgttgatgctactattaaatgctaattgaactttattaattgtgtcttgaatatttattactgcatcagatgattgctctgcaagttttcttacctcttctgctactacagcaaatccttttccttgttctccagctcttgcagcttcaattgccgcatttaatgcaagtaaatttgtttgttctgctatgcctccaattgtttctgccataacttttatactctctactacttttccatcttctatggctttttgcattttttcttgcttttcaatgtataatttcctagtttcattaatagctttttgactattatttttaacttccatagattttttcttagactgacttgcattattgcttccctccatggccttagaagaaagtacattaacgcttgaatctacttcttcaatagatgcacttatttcctcagtagtcgcgctagattcttgcattgcagaggcaatattatctactgcttgatctatggtgttggcctttgaagatatttcttcaactgttgctgaaagttcttctgagcttgcacttaaatcctgcgagttttccataattactttaaccagtctacttacattttcttgcgcagtgtttaaagctacgcctgtttgtccaaactcatctccccttgtaatcgtaatcgcattagcgaaatcataggttgataatctttttgcaaagtcctttatctctcttaatggattcaatatattcttgcttaacatatatgccataaaaagaattattaaaaatgctcctgttgtaaaaattaatatagtatatcgaacactcttaaattgagatatattatttaaattagcttgctccgcagcctttgcatttgcatcaatatttttttgaatgttttcaagtaaagaatttttaattgtggttaaatcggaattgctaattttaattgcttcatcataatccccggttttcgcgaattcgattgctttatttcttacttctatatattttgctaaatcatttttcaaattattataagtttgtttttcgtctgacactgtaattaaattttcatattctttcatactcttgtcattttttatgtctaaatcatttataacctttagataatcatctagttttgttttatctctttcgaaaactaatctattatatgtagctctcatgtcatggatatttccctttatttctcctaagtctttaatagatattaaattatttctatacaagacatctgcattatcatttatttttgcagagcttaatattccttctgttcctattgcggctataaaaatacaaatcacaaagaacactgaaacaagtttcttcttaacacttaaattaataagaattttcattataacacttcctttttttaataatatatccccaatttttcgtacagaaattaatttaaataaaataatcctgcaattataaatacatagttattttccattataaactctagtcattttttatcgacttatttcattatttgtaataattttacaccatttcaaaatatatttcaatattcgctatataattactacatttcttactccattgtttagtgattaagatgctgtattcaacttgttaatatataattaattaaattcaaataacaaacttaaaggataatggtatagaaaaaccaatatgtaatgttagaattaatatgctatattaggtaatttctataattaaattgccctattgaattttaaaacatatatgatataatgtttacataaatttcatattaatccaaaataatcattatgagattaatacgaaaatttattcagtttaatatcttcaaagataaaaatttttaagttttgtgcaaccgattgcaatatatgcaaaatataaactctagttacgcattattttattcgtgactaatacttaatagagagggggaaaataattactactttgcatgtataaacaaataaatatactattgctgtattttttgcaaccgattgcgctatgttaaggagtgtgtatcaatgagaaaaaaaataatatcaagattaattgcttcaggtttatttttaagtttaaacttacttccaatttcaataccaagctttggaacaaacggaattttaactacagcttatgccgctagtagtactagcctcccatctaatgctaaagatggagctattcttcatgcctttgactggtcttttgcaactataaagaatgaactaccaaacatagcggcagcaggatataaatcagttcaggtttctcctgtacaaggaacaaaaagttcaagtaaagatccaagtcaatggtggttattatatcaaccaaccaatcaatctgtaggtaatgctcaacttggaaactacgatgattttaaggcactttgtactgaggctgataaatatggaatttcaattgttgtagatgtagtaatgaatcatatggctaacaatggaaatccagatcaactagattccagtatagatcctagcttcaaagaccctaatttatatcataaccaaggacaatgtagcaattggactaatagatatgatgtgacgcaaaaaggtataggcatgccagatttaaatactcaaaattccaccgtccaaaacaaagcaataacatttctaaatcaatgtatagatgctggtgctgacggattccgttttgacgcagctaaacatatcgaaactaatattggactagactctaatcaatcttggtctggaaactactggagtaatgttctaggtaatctgcataataaatctaatttatttatttatggcgaaattctacaagacggttcagtagataatattgcctcttacgaatcatttatgaatgttactgcaagtaattatggcggagcggtaagaagtgcagttacctcaacaaatttaagttcacttggcactaccttgggtggcgttgactcatctaaggcagtcgattttgttgaaacccatgatacttatgaagatggatcaagcaaaaatttaacagatactcaaagaaaacttggctgggctatagctgctgctcgtgcaaacgctacacctttattctttgacagacctactggcaatattggatccaagggtgatgatctttggaaggatgctgacatagtagcaattaataacttccataatgcaatggtaggaaaaaatgaatatattaggtggacaaacaataatacaaccatgttaatagatagaggaacagatggtactgtaatagtaaacgatggtggaagtacttctattaactctcctactaatttagcaaatggcacttatactaataaaggtagtgctaattgtactttaacagtttcaaacggaacaatttcaggaaatattcctgctaattcggtaattgttctctacaatgatggttcaatacttactcctcctgtaccttctacttatgctcctcattcaggttataaagtggattatgatagcagcactttactacaaggtaacagttttactttatactatagtggttctttagcaaattctagttcagttaaactccactggggatataatggcttcttaaatccatcagatgttacaatgactaaaggttcagatggattctgggcagcaactataaaaattccttcatcagctacaaaactagatttcgattttactaacggatctaactgggataataactccagcaaagattggcacttacaagtttcttcatcatctgtgccagtacaagttaatccagcgccaacagctagtaaaacaaccactatatactacaatggaaacttagcagcaaattcaacttcagtaattttacattggggatataatgattttacaaacccaactgatgttacaatgactaaacaatctgatggtagatgggcagcaactataactattccatctgctacttattctttaaatatggcatttaaaaatgattcaggatcttgggatagcaatagctcagctaactataactattctatatctcaataattctaattcataattatgttataccaatccttcaacttgattaatatataataaaaaacagaggttgcttaaaaacctctgttttttattaaatttctattcttttagactaaactaatcaataaataatatcatagctttattcttatttttataaattaactatgcagtagctgtaacactttcttctacatctacatctttttcatttactaataagtttacaaacttttctccataagggaggcagaattgtataaatggtccagttgttatcattgctatcacagtaccaagaccaacttttcctcctaatataaatcctattattaaaaatccagcatctagtgttattctaatccaacggtattgtaccttagtcttatcttgtattataaatggaacaatatcatttggggcaactcctacgtttgttgctgataaaactgcaaaccctattgcaattattaaacatccaaatacaaccaataatgcctttataaaatagttataagattcaactgggaaatatgaaacaaccttcactccaagatctataattggtcctactcctacaacacaaattaaagttcctatctttatacgcgatctctcaactaagagtataacagcaaatagtacaatcaatataatcatatttgctacccctggtgttacttgatctgctccacttatcaacttaactacagaaacattctttaatcctgttttatctaatgcaaacgctaaaccttgcgtaaatacagtaaatggatcagagccaatattagtcttcaaaaataatgctacaccaaactgaattatactcattccaacaaaaaataaaataattctttttaataagttcattgctttattcatattatttcttccttttttattataatttattgctacatataaactgaataaacataaaatagatataattatgtatcactttttattatataattttctatatataatcttaaataatatgcacatgtacaaacataaaaccattttactatctaccatccattttgtcaaaagaaaaattcattttcattcattttccaccatattaattcattgtatataaaacaatttaatttacatttgagtataaaaaaggatattggttctaatggcttttatttttaacccttggaacaaatatcctcttattttatataaaatattagcttaagtatatatcttattgtttactgaaatctaataaagatcttatttttcttgtaaatactcatctattgcttttgctgccttcttaccagcacccatagcaagtattactgttgctgctcctgtaactgcatctccaccagcataaactgcttctttagtagtaagacctgtttcttcttcagctacgatacatcttctcttattaatttctaacccttgagttgttgatgaaattaatggatttggtgatgttccaagtgacattattacagtgtctacatccataacaaattctgaaccaggaacttcaactggacttcttcttcctgatgcatctggttctccaagttccattcttacacatttcattcctttaacccatccattttcatctactaagatttctgttggattagttaatacgtcaaagattactccttcttccttagcatgatgtacttcttctactcttgctggaagttctgattcacctcttctataaacgatatggctttcagatccaagtcttaaggcagttcttgctgcgtccatagcaacatttcctccgcctactactgcaacttttttaccagatctaactggagtgtcgtatccttctactgctgctttcattaagtttactcttgttaaaaattcatttgctgagcatactccatttgcattttctcctggtattcccatgaatcttggaagccctgcacctgaacctataaatacagctttaaatccttcatcttcaaataattgatctatagttatagttctgccaactataacattagtttctattttaacaccaagtttcttaatgttttcaacttcatttttaactactttttcttttggaagtctgaattctggaattccatattctaaaactccgcctgctttatgaagtgcctcaaatatagttacttcatatccttttttagctaaatctccagcacaagtaagtcctgcaggaccacttcctataactgcaactttaattccatttttaggttctgttgcacttaaatcaacattatgtgatgctgcccagtctgctgtaaatctttcaagtttaccaatagatactgagtcaccctttattcctaaaacacatcttccttcacattgcctttcttgtggacatactcttccacaaactgctggaagtgagctgtattttgaaatttcttttgctgcttcttcaaatttttcatctttaacataagaaatgaatcctggtatattgattgatactggacatccttctacacacttaggattcttacagtttaaacatctagaagcttctttagttgcttcttcttcgttatatccaagacaaacttcttcaaagttcgctgctctaacctttggatcttgctctcttactggtattctaactaatctctcattcatgtccattatttatcacctctgcaaccacagccaccgtgactatgagtatttccttcttcaacttctaactgtgcttttccttcttctgttttatacatagcttgtcttctcattgattcatcgtaatttactaaatgtccatcaaattctggtccgtcaacacaagcaaacttaacttctcctccaacggtaactctacaagcaccacacatacctgtaccatcaaccattattggatttaagcttactgttgtttgtattcctaattccttagttagcatagaagtaaatttcatcattatcattggtccaataataattgcatgatcgtaacttttaccttgattattaactaattctttaagcatatctgatccagttcccttaaattcatatgaaccatcatcagttgttacataaagatttccagcagcattctttaatttatcttcatatattaataaatctttgtttctgcttcctaaaataacatctacagctattccatgttcatgcatccattttacttgtgggtaaactggtgctgcaccaactccacctgccacaaagatgaaattctttttctttaattcttctatatcctcatgtataaattcacttggtacacctaatggtccaacaaagtcagctacatgatccccttcattaaaagcagctaactgttttgttccttttcctacagtttgaaaaactatagttactgttcctttttcctgatcataatctgctatagttaaaggaattctttcacctttttcatcattttttatgataataaattgtccaggctttgcagattttgctactcttggagcttctatatccattgaaaatatattatttgttagctcctttttgttcactattttatacatgccatcgcaccccttttaattatgttaagttttatcacttaatatatagtttacactattattctgaatttttaaaatagtttttatatattttaaaaatttccatcaataaaaaagttatggttgatgatcaaaatcttctaccataactttttataattttatcaaacttatattaggtacataaaaactaacaactcaaaacattattattttcataagacaatctataatgcatatttcaaagccactactaatcattataatacaaaagtcgctatgtacatgaaatcaattcctattcgcatcctcttttttctaaaaaattaagttatctcaattttttcattgattcaggcatatcttcaacaccaaatctggcaaatgatgctggagctaacgtaaccattgaatttgacattttttctaacaacaaacctattaattttttaatcataaaaacatctccctttgcttattacttttaatatagtgcccaatttttaactttctctcttattaaacattagtatagcttgaaataaaattgtccatgttattaaagaataataaatactgtaattatacaaaaccacagacaatgctcctaaaaatattgaagtgcttaaacctctaatcctattgttcattagtaattgaggacgcgaaattggcattttagaattgattattggagcttgattccatatgcagaatatacttaaagaaattaagatacaattacttataaaaccaatattacattgtaaacttaaaatcaagatcccaatttccaatatgagtgtagctacaaaacatttaatctgtgtattttcatgataccctccaatgaaaggcttaataacacacatagtcaaatcaataataattatttctttaaaatatccaaatgctgaaaaaattgttatcactaatattgtttttattaattcatttagaagaacttttaatacatattccatctgctcaagtttatcttcgttatatttctcattagttgatatactatttataatttttttcgaaatactatctaccatattaatatcactctcatattattttcaagttaagtatatatttatataataatcctttttattacaatattcaatattttcaccactaaaaatccttcatcttatattttttccaaaaatagtcctaatttagttaatatttaatatatgatattagctcatatattaaataaaaaaagtatgttattgtcttgtatataaacaatagcatactctaactttcgattatttaattggtgagattattctaaactaagtatagccattagttaagtatactaaatattatacaaaattctttataggaaatactattttaaattcagtaactacatcgctacttttcacatatatcttaccattatgactctctactaaatcctttacaatacttaacccgtatccatgactttgatcactattttcctttgtagtaaacccaactttaaatatatcattcagatgttgttctggaattctagggccattattctctattcttactattacatttcctaaatattcataagcctttgcaattattatacctttgccgttcattgcttttattgcattatttactatattagatattattctataaaactccatttcagtaatactcactaaagagaaatcacaattttcttctattattacatgtattcccatatcaatagccggttttaatgcaagggataatatagaatttctattctcgctaacttctacagctgttggcgtagagtcattcttatttataatatcttttagagatttttttaaatcatcgaatctttccattagacaaagtccatataaatatgatatctgtgctccgtagtcatgcttaatctttctaagttcgctatttttttcttctagagcttcatttaatttaaatatttgatctgatttcttctttatatttgcaaaatattttatgataaacgctaaaaatacgcacaagattgtgattatcatattttttaacattttagattcatcattatagattattaaataaaaggccaaaacgaaatctagacagaagcttattgttataatcacgatcatattaatcttttcactaactgctagcttgtacatttctataaacttgcccatgtattttatacataagtataagaataaaatataaggaacatatataatcaaaatattagctatatctgcatattctactggtatcataccttctataaaaccaaaaaataaattatatgatataattccatatacccccataaaagaatatgtcaatgtatagggaatcattgactttagtttgttatctttatatgagaaaatcattacaactaaacatgatatatgtattataaacacacagatagatatgtttccaaatatacttgtaaagctactgtttataataaaagtaactatggttattaaaactactttaagtttgtttaatttattttcactcttcaagcagcattctgttgaatacgcgaaaattatagcttgaatcatagagactattatatctgccaataaacgcaccaaaaattcctccttaaatttacgtgaaagtgacttatctcaattttttcatagattcaggcatttcttcaattcctgctgtagctgctgatgctggagcaaatataatcattgaaagtgataacatcattaataccttacctaataaatttttaattttcataaaatccattcccctttcaattttgcttaaaatttatcattaatatttcaaaacattaagcatcttttttattaaacattaatatggtgttaaataggattgtccatgttataagcgaataatagttgctaaaattgtacagacatatagatgttataccaagtattgttgcaatacttagacctcttattctgtttttatttattaattcttggcgcgtaattggcattttaggatttattattggaacttgatgccataggcaaaatatacttaagataattagtatacagttacctacaaatgagagagtgcactgagaatttaacaccaatattccaattgctaatagcactgtggctataaaacacttaacctgagtatcttcatggtatccgcctataaaaatcttagtcatactcatgactgctaaaattataataattttgtcgaaatatccaaacaatgaaaatataactataacagaaaatagctttatcgtctcaaataaaatactaactagaatatattccatttgttctagttggtctttactatagttatcatttgtagatatactatttataattttttttgaaatactctttaccatatttatctctctttttatatatttttctatatgttaaatatattatagtcccttatttgctaattttcaacatatatttattcatctccaagtcgttaataagcataatttgtaaaaatatttttccaacattaattagatgattattataaaaaaagtgccttaataagtaactattaataggatgctttttctttaatatattataaatattaatttagtcttaagtataattttatatactaatgcaaaaatcggtatttttctacatttaaaatttaaatatgattaaatatatattcaaattaatttataattatatatatatctattttaatttaatgaattgtatatatatcttttattcataggaatattttcacttcagtctcagcactgtattcttactacatacttttctattacctcttctcattttgaaatactatggtaaattctgcatgaacttattgtactgaacattgaacaatgttagtataatactgttcaataattgaactcatttatatgaataaaacatttcttatttttattcaatttaataaatttcaggaggagagaattatggaagatatgtcttattggaaagaagtttgggaaagaaaaggaaatggaaatactacatgtttagaggaattagacggatatgaagatactactgctgatgtaaaagaaatagctaaacaaattgttaaagaattagacattaaggaaacagatagaatattagaagttgcctgcggagcaggtggactagctcaatatataaaatgtggtgaatacgtaggagtagattattcctcttctcttgtaaaaaggcacatagaattacttagcaattcagttcttcacggagaagcaaataatctaatctttaaagataaaacttttgataaagtattttgctttggagcatttcactattttcctaatcaagagtatgctaaacaagcaatttcagaattgaaaagagttgctaaggaggctatatttattggagacctacctatgacttcacacagaaaagagcacttactttatgataaaaatgactttaaagactggaaaataactgatggatattataatccatgcaggttcaatgtatctctaaaattagtttaattgataagtaaagacaggtatctctcaatacctgtccatttaccttgttcctgatgaaccaaatccattctgatttctttcactttcagatagttcttctatttctattatgtcaactttaactacaggttttataaccatttgagctattttcattcctggttccactttgaaaacttcgcttccatgattaattagaataactcctatttctcctctgtacccttcatctatagtacctggagaatttaacgtagttataccattttttaatgcaagaccgcttcttggtcttatttgagcttcagtatttttagggagttcaatttgtattcctgtatgtactaatcctctttctcccggctttaaagttaattctttaactgcatataggtctaatccagcatcaccttcatgagcataattaggtatcacagctttatcatcgattttttttatttttaaaatataattatccattctaacacctacttaaagattatataatattatgattatataattttccaatacaaaaatccacttcttttatttaaattaaagtattctataatttttattacttaattaaacatatgcaaaaggttatatttacgaataaattaatttattttttaaatataaccttaattctttatttaattcttatatttgttttgtgccataaattttttaaatttattaactactactattttttgtttcttattagtattgtctattattatttcgttccaatttatatacttaggtttttcaaagtatcttttatcaataatctcaattatcctataacagccttcctcaactccagaaaaaataacttttccttcctcatctgtaactttcgatttaacaagaacaggagataatccatttattttatataaattaatttttacaccttttaaatattcgtgttcttcacattccaaaattgatgtaacaataatttcccctccattacaatctttttcttctactctttggggacttgcagatttctcatttaatatgaactctttattatctcttttctccttattatcatcggatatttcaaatttataattggtattattttctacagatactatatcattaatattttctttttcataatttctaggaacagtatcactcataaaaagctcctcttaaaaattggttctctttatataatatgataaataaacttttatgtgattatgaattgaaaacattctaaaatgtattgttagtttaaccaagaaaaatggaactacctatttctattaaaaaattcagcacattatagtcattacaaataaattctttctcatttactgaaattgaaaggtatataactgctaatagctctccgttacaaattattggagctatacagactgatttccagtcaggaagcccataactattgtgactgtccatgctctcccaatctactaaatacaaacctttttcttcttcaatgacttgatttactaatttaaaattaaacctatcatctaaattccaattatccttatttcttctcttactatacgtattaactattttcttctcttttacaataaaaattgtagctacatcgcactcaatcgtctgcataatctttaaaataagattataaatcttttcttccttactacatctacgtttggcaataccagctatttctttgagcattaacataaaattataatctttagccgcatttcctgataatactccagttaattcgtcatttgtatttccacttgctccgcactcattttcccaaacgatgcatctattttttccatcacgtttagccttatatagagcctggtcagctctccttataatttcttcattgttaagagattcataagaactcattgctattcctatacttacagtcacttttcttttatctcctagaatccttgcttcctctatattttttcttattctctcccctaaatttatagctgcttcacaattaacattaggcaagagaattataaattcctctcctccatatcttccaataatatcacctttgctcatacactttttaacttcatctgcaaccttaactaatacttcatctccagtttgatgtccatacttgtcatttacgcctttaaaatcgtcgatatcaaacatcattacagcaaattcactttctcttgccttcgcagaatctaataaaaaaagtaacgcttcttcaaaatattttctattataaacacctgtcagcttgtctagtgtagagcttattgtaagattatacttttctaataaaaaggttaagaaaggtttaaatttctctattgttttctttgattcattatttatataatttaatgcgttgttagtaataaatattaatcttgcattaattcctgcactactatttatgtgtttttctctatttattattttcatatacatacaagatcttattccatctttcagtaccttatcatctaactgatagaatctagggtcattactgcaaattgcgaatgtatcttcatctgaatcaacttttagtgagaggtatctatttatttcatttttgtcgctaattctatatgtgcatataacatcattttctccctgctcgttctctgtaacaatcatagccttatctgctaaaattaatctagccatatacttcatcacattttttatatcatcaatagtattattagaaaacttctcaaagactttaaatatatctctaaaatcattgtaatagcatttttcatataaatattgaaccaatttaaatgtatcttcattatctagtatattcattaaatctaattcttttaatatttgctctaaatcctcaattgtttttataaattgtgttgatttaaaactcatatttatacccaaatcttcatttaagcattttacaaataacttacgggtttccaaaaacctactattatttgcatatgataacttatcattttgtggtaataaatttattgtatctatatataaagctatagattcataataataattcaatgccaatacattacattcaagttcattatacttctcaccaatcgcagaatatatatcagctttaatttcctgattatccacaaaagagcatactcttagtgccttatttatcagaaaattatattgatttctatttctaaaattgagttctagatatacataaattccttcaacattataatttttaggatatccattgagatcaaagaataattctttagccaatcccttatatccaagtgttaaaattcttctaatagcacttatccttatttcgagacatgtatctacatcctgtaatagcttaatttttttctctaacttattgtatacatttcttatatcactctcatttttacatttatataaaataagctcaaagtaattgcaaacaactattttatacttagaactattgctattaaatattagagcatatatttttttcaagtggtcatatgccaaatcataattacaaatcatcagattatataaagcatatgtatagtttgtatttataattctatcttccaatagctttaatcctttttgcatttgcattattaaattatgatactttactaccagacttatccttcctgattttatatataacaaacaaagttcattgcaaatattaaatgaataagagtctatcccctcttctctttctctttctagtgctcttaatagatatttctctgcttctaaatatcttttttcctgactataaatatctgctatgcaaattagactcaatatttccctcttgtatactttctgtttatttccttctctagctatttctaaatattgctctaaaatctccttgttatctcttccttcttccttacagacagatgcatctaatagtttaatatataattgaccattaatattattgttattaataaatatactgtttgcatataaacataaatttttggcctctttataattccccttctttatatatatattaataaggatactcactgcccaaccatatacatcctcttttatcttattttcttcacatataattattgctttttgtgcattaagcatcgttaatttattgttatattctaatctatattttaatgaaagtgcatagtaataataaacctctcccttaggatagtgttctttatctagcaatcttcgtacacaatttaaagaataatctatccctgtatctatatctgtaatactattaatttttattattatcatttcaagcagcgtatatatttcaatttcaatttcgtcattctgtattgctatttgatttgccttttcaaaatgttcaaaacttttttcatggttagattttttttcataaagctttgcaatcttaattgccacttcacttccacttgaatcactaggatatgttaataccttcttataatatgatattgccttcgatatatcacctaacagatcctgagcttctgcgtattttaatgtataaaaatatgctttttcgtaactattacttttttctaaatgcaataataattcttctatataataatctgtatcaagtaaaattttttccataaaaatagatgccttagagtgtaatttaattctttcttcttcacttagctttaaatacaatatatttcttaataaattatttctaaaacctataagtataccttgatcacttattttatcagtcaaaaggccttttgattttaaattatcataaatttctatattatcagaatccattattacatattctaaaattattttttctgataaaggagttttaaatatagctaactcctttaaaatattaatttcttcttcatttaatgaaaaaatacttgcctctaatcttctttctagagatttgggtataagtatatcttgaaccttaatattagtcttccattctccattattgctatcaaaatataaggttccattaccgtataattcatttataactccacttatatactgtggattccctagcgtttctgaatatatctttaccgctaacttattaacatcagtacctgtattaagcatacttctaatcatcttagtagtattatattgattaaaataatttattttatattcttcgtacttctctacttgttttagttcatttatgaactttatgaaattttcatcaacactgctttcattcatagaaaatattatcataacattttctaagttatttcttaaaaagattatatatttaataaacagtttgaaaacttcattttttttatctaaatcatctattatcattataaatggcttagtcattgtatactcacttatgaacttccccattctattaatcaattgaagcttttgtttattattttcactatttgtagaatttttttcaaataatatagaaataaatttttttatataaatttcatacttatctctcaaattcttatctactttatttaaaatgtaatttagtattgtattatattgctcttcgttgcttgcatttttattattaaaatcatcaatatatataatgtctttgaagtatttattttcaaatctatatttaatttcttctaaaagtctggtttttccgcttccatcttcaccattgaaatttataaacttatttctctgcttgttttccaatatcctctgaaaatttttttccactatttttatttcttctgtcattcctattatatctaaatccgttttaatcttatttaaagcctcactaataaacactctatagttcttcttcatttttttgtttatattttgtataaaatatttaagtttaaacgatttatttatagtattcactcgattatatatattttttatatcttctaatcctttaaatcctgtttcaagttctgattctgtgaatatttgtctgcacagttctgcaacttgtacaatattatctttatttgaatttatatcttctcttgtttcgatgttatattggtaaggtaatgaatttattaaattaaactttcttaattcatttgctaacaaatctttcattttgactttcacattattgctagagtcgggaattaatattacatccttcatactaatatcatcaaatatatatccctgcatgtttagcgtattgatagcagcacaaatctccataaatgtatctaatttcttatgaaagtcacatttattaaaataatcttgtgtatccagtttagcctctacatactccattaaatacccatattgaggagtatcaagttttatcccattaatactataaattatttcaatatttataatgttagtaacgttctcaaaattaagatttttaatagtcttaaatttactcaataaatattctcttgttttctcatatgtaaaaccatttttcaaaatacatagaacatatcttgcgtctctctctatgtctgtaacaatataatttgaaaaattctcttcaataactatctcatgctctattagatatttattatttacatttctcaattctaattcatcccttttcttcactaacttgaagtttaccaatctatctaaaattataccatattttagcataatcctgaacactattatatctaattcaattaattatctacttttttacataaattcatatttttataattataccttcttaattatcattgtaaccaaaagtatataaaggcttataatataaatttaattttaggacataatactttttgtaaaaacatttaggaaggtgataatatgaaactaaaatcgctaaagaaatacattccttttgttttgattataataactataattaattatcaaaatcttcttatgcatacggttcttgctgatgaaaaaaaaataatatatctaactttcgatgatggcccagctggaaaggtaaccactaatgttttggacatattaaaacaagaatctgttcctgcaacctttttcttaataggaagtcaaatcaaaggacaagaagatttagttaaaagaatgtataatgaagggcatgcccttggtcttcatagtatgagtcataatcgaaatatcctttatcactctaatgaagaatttctaaaagagatgttggatacccagcaaataattaattccatagttggtattaagccaactatactaagattcccttttggttgtaataataactgttataaaatttcgcagtctatggtggatttacttcatcaaaataacctaaaaatttacgattggaatacagatagtggtgatggtgctcaccctaatgctagtccaagtacatttattaaaaattccaaaagtgacaaagagcgtgtagtactattaatgcattgtgcatatatgagtaaaaattcagtaacggctttacctagtgtaattaaatattataaagataatggctatgaatttaaagcaatcgatgaaaatactgatgaagaatatcatttcatgaaaaaataataatgggtaaaataacgaagctatctcaaaattaatccttttgaaatagcctctttaaattatacaaaatatctattctaccgcatagcttccatttaccgatgtaatcttttcaacaattttaaacattataattcctgatattgtattcactattattgttggcacgactactgatatgaaaagtacattaaacgataatcctccaggtaatcctactatattcgctagtaaagttaaaaatactgttccgctcactaaagttcctaaaggtaataatattgatacttgcactaacttattaactttatttcttaaaggcattaatatcaaatacatgacattacaagttataaatttatctataatatttggtaattgtcctcctggtgttttagttgttagtgctgcaaacactcccataataatcccacatagtaatgttgttttataatctttattaaacactattattataaataacattgctaatgagaaatctgcctgcataccgaatggtggtgtaacctggtgtaatattgctcctattgctattaaaattgcatttgttgccattttctttgtattcataataaaaatccccttgttaatctttgcttattttatttttaagttgaaaccactttctttcacaacatacttatcacgccccaatatttaaatatatttctttgttatgcttccaaatatagagtcttttggttaacaactactaaaaaagaatataaaaaaaccgtcctataattaataggacggatattatccgcgttgccacctagattgcataaaatgcctctcatttcagatacaaacatatcttattcgctataacgtgcgacttacggctaaactactctcaaaagatttcatctcgctcctcaaaggcccattcatcattaactaccgtactgaaatctcaccaccttcagctctctttaacattgttatatgattactatccctcttcataggatttattttatattcttatattatatcctcaaaaagtgtttgtcaacactttttataaaatttccttaccgattatattcttaattgcgtcaaacattcttggtttactgaaatagtatccttgaacaacatcgcataatattgttcttaaatattcaacttgcgatttttcttcaacaccttctgccactacttctatccccaattgatgtgataagtttattatattctctacaatacatttactcttaggattgttcatcaaatcaattacaaaactcctatctatctttagcacatctataggtaattttgtcaaatagttaagtgaagagtatcccgtcccaaagtcatctaaagcaatgcttactcctaatttttttatctcctgaaggatcttaacgtttctatcaaatgatttcattagcatactttctgttatttctacttctatatactttggatgaattttatatttctttattagttttttaaaatctgataaaacaacatcctctctgagctgcatttcagacaaattaactgctatcttaaaattatcatttccctcgtttaaaagacatttcgtctttttgaatacttcttccaaaacaaaacttccaattggaattatcatttttgaactttctgcgatcggaataaactccgccgggcttaccattccaaattcacgactttcccatcttgctaaagcttcaaatccgtttaccaaagaatcatcgagtgatactttaggttgaaacataacatataattcattattattcagtgcagttcttaaccctttctgcaagctataaactctgtttagctcatcagaaaggctatcatcaaaaaaatcacactcatttttaccatttttctttgcttcatacattgctgcatctgcatttttgagtaatgtattataatctattccgtgatctggagatagagaaacaccaatacttgctgttaagtatatttttcttccattcactatattaggtttttcaaaagactttgctatagcattacccaaagttataatttcttgtatatcaattatatttggcttaaatagcagaaaagtattgccgctatatcttgatactaatatatcttctgtaacagattcgactatattatagcccacttcttttaacactaagtctccaaaatcatgcccgtaggagtcgtttacatatttaaaattatctaaatctattatcagcatcgcggctctagtattactattaacaacattttgtaacattttggctaccgtgttcttgaaaaaatatttattaggtagccctgtaattctatcactatgaattattgaatctattgttttattgaccatagattctttccaatttttcgtcaaagaatctatatcaccatattcattctctaagtccttaaagcaataactagttccagtaaagtaatactgttcattacttttaattgacttcccgacaagaataaactcaacaatgttccccctaggactttccatcttgtattgtagctgcatttgttctctatttatatagtgtctctttaaatcttgagagaaaaagcttaaaacattttgtttatcttcttcaccaacaaaatttataaattgatctaaagtttcattcttagtatcatactcttcaaaaaaacttttcattgtatcatcaattattaatttaagctctgattgattccaaattatattaacgcccaaaattggtatagaatcaaatatttcctcatgatttaattgaagttcctccctaatcatatatatacaatccttcacataattctataatttgtactattcctgtttgttagaatctttagatttcttatcatttgctaatgatgctattaaagctgctgttgctgctataacagtaattaatttgcctgtcttttttaaattcatataacatcaccttcctaactttatgaataattatttattaagactctaattcttaaattgattttcttcttcctcgtatttatatccgatacttattaatatatttataatatcgtctttagataattctaaatcatcacaaagaatatctaatgaaccatattgatctcttaatttcatgtttattacacttaacaatatgtttggatcactgatccccataggattattttccatctctactcttccttttcatctattggtatatggttaattatagcataacatacatttccaaattaataaatacttttagttacttaagtctactcttcatcgtaataatctagaaaagaatgcttttcttcgcccttttgccaacctaatattgaatccatactaacattttcagctgctttaaagatagacttttcaactccgctaaaattcttctttaattctttaataagatcttttatttcatatctcttattacctattctttcagctgcaaccatacaagcgcaattcaatggccatataccactataatttataaatctttttatatactcttcctctataaaatacataggcctaattaattctaaaccttcaaaatttttggcctttagtttaggcaacattgtcttaaaattaccaccatataaaatgtttagcatagttgtttcaattacatcattataatgatgccctaatgcaagtttgttacatccaaattcttttgcttttgcataaagagagcctcttctcattcttgcgcacaaataacatgggtaatccttagccattttatcaacaacatcaaaaatgcctgattcatacatgtgaatcggaatatttagatgctcacaattttctattagtaaattttttatatctggatgataccctggatccatagctaaaaatactaattcaaatttaacttgaccatgtctttgcaactcctgaaataattttgccataagtatactatcttttcctccagaaattccaacagcaattttatctccttcttgaattaaattatattctttaattgccttaacaaattttgaccaaatatgctttctatagcttttaattatagctttttcaatctcttctagtggctttttttctccatctggtataattcttggacagccttttcctgcaattgtactcattatttcatttctccttattatcttaatagtatccagatcatagatactaattgttcttgaatatatctttctttaaagagtttataatgaacacttaagatttacaagtgtttttaggttttaatattagctgattttaattattcgtattcgtactttgattttcatatatcaaagtaatgtttatttagaaagagatttcactagttcttcagggtttttgtctttcatcaaactagacattatagcaattccacttgctccagcatccaatactttcttataattatcttgatttattccgcctattccgataattggaatgttaatcttcttggaaagagcctctatttccttaattcctctaggaggaagaccttttttacaatcagtttcaaacacatggccataaataacatagtctgctcctaatttagccgcttgtataccttcttcgcaactatgtattgaaacgccgatcatcttatatattttatatttattcctactaaaatgaaaattatccaccatttctttagaatttattgctcttcctgtgcataacctgttactaatatttataaaatcattaaatgataactgaattccatcaacattggactttttagcaatatctatattggaatttagtattattctgatatttgtatttttcagttcctcttttactttcaaaactaatatcattagctcttcactgcttaaatctttttctcgtataattaagaaatctagattagattctgatattttttttatttgatcaaaaaagtccctacaaagttttctatttgttattccaattacagacatctttagtttatacctcttctcctaatattaatctaagcgccatatttgcttcatgacaagctgcgataccaactctaggtgccattagcccctcatttacttttgcctcatttttaaaatctccacacatatatagccttgtatttatttttttgctgattattagattattagaataatatcctgccatacctgaggctgaaataacctttggtttttctgtctgaagtaaaacttctctaactatcatcgctttattttctgcaccatcaaatgcttcaattacaatatccatatcctcaaataaatctttaatgttatccttatctacatacgtatcaacaacttcgatatttatgaacggattgatttctaacaatatttcttttaatgaatggcattttttcattccaatatgtcttataaagtattgttgtctgtttaaattactaggttcaaccacatcaaaatctattatttttatatgtccaaccccaactcttcccaacgctaatgctactgttgaaccaagtccaccaagtccagcaatagctatcttcgccttcttaactttctcatgaacctttggagtatgtctacttaccattagtgcctctaactcttcttttttaggcacctcgcctctcttaattaaagtaactttatcgccttcatttagagaataatcttgtttaattggaaaaccatttaaaataactatatccgcatcactttttatcctgcttctaacttcaaatgcagtaatttctccctcaatatctatttctctttcatttactaaaactttcaaactaatatccccaatctaaataaattttaaaacttaatatatctgttcattatttactcattattttcttagcagtcttttttcataatttgtacgaccaatgggcagaacctctacttatttgccttccatcaataaattactagataataaaaagacttaccctaaggtaagtcttataaatcttctaaaatatttattgcttccctacggtggtattagccacatcaggtcaaaagagttaaagcaaataagcttctctcagccaattaaattggcacccctagccttttatactattcaatttctgttatggttatatattatcattttatttcttataattcaaatttttatggattaaatccataaattagatttgtgaatttattcatattttgtatggaaatcaacttttttctaagttcgtagaattaaatatagaatcagtaattattattactatatttaagtttatatttttaaaatataattgaacattttttctaacgtggtaaaataatatgtgtcggtattcaattagaagctgaacggaaattcgtatatattatatatttttccgaattatatccatatatcaaggaataagaacggaggtaccttatggaaagaggctatactaaatctaaattttcagttagacagattgcaatgatcggaatgctttctgcaatttcaattttcttaggattaaccgggcttgggttcataccaattccacctgtaaaagctactataatgcatatcccagttattataggtgcgatagttgaaggacctatagttggatccctagttggattagtttttggtttattctcaatgtatcaaaattttaccgctcctggtccaacatcatttatattttggaatcctataattgcattagttcctagagtcctaattggaattgtagcatactatgtgtatatacttcttagaaagagatttaaaaatcaaagcattagtattgcaatagcatcaatctgtgctacattaattaacactataggtgttttgggtttaacttacgtattttacttagaaagatactctgctattttaaagataaatccacaaactgctggaattgcaattgcaaccattggtttaacaaatggagttcctgaagctatagtgagtgctgtaatatcagtccctgtaattgtagctatatttagaattaagaaaaaaatttaactaaactctaaacaagtaaaataaaatattttttaaagaatataaattataaagaggcacttgctaaaagctgcctcttttcttgttctaattattggttatatataaaactattatgaagaattaaaatatggtatataatacaaatataccgattcctatttactacttaaaaagttactcacatttttttgattataattttctagagaataaaaattcctatagatcacatttatctacaggaattttacaaaacttattttttactaaagtggttttattattatttcttcatctttattatcaatcacaaccttagatccatagcctagttcacccttaattatcatcctagcgagtctattctctaaagtgttctgtatatatctttttaacggccttgctccataaaccacatcataaccttctcttgccattattgtttttgctttatctgtaacttctatttcgatatttttatcttttagtcttaaacttacttctcttaagaatatatctataattttcttaatgccagactctgtcaaaggtttaaacattatagtatcatctactctatttaaaaattctggtttaaatcttgattttaaaacactcattacttttgattttatttcttcatcaacgtgatcttcattagtattttctaataaatattcacttccgatatttgaagtcataattattatagtatttttaaaatctacagttttacccttattatcagttaatctaccatcatctaatatttgaaggaatatattaaacacatcttcatgcgctttttcaatttcatcaaataaaattacgctatatggttttcttcttacagcttctgttagctgaccaccttcatcataacctacatatcctggaggcgctccaactaatctagacactgaatgcttctccatatattccgacatatcaattctaataatattttcttctgaatcaaataaatttctagctagtgtttttgcaagctccgttttaccaactcctgttggccctaagaatataaatgatcctattggtctattgatatctttaagcccagctcttgccctgagtattgcattagttacagcttctattgcctcaccctggcctataactctattactcatatcatcttctagtcttaaaagtttttccctttctccttcaagtaagttagttacaggaattccagtccatttagaaagtacagcggatacttcctgctcagttacttcctcttttaatagagctccctcataattttctcttagttcaatttctttttgcttaattttttcttctatagcaggaatcctactatattgaatctcagcaactttattataatcaaagtttctttgcgctacttctatttctcctctagcatcatctagctcactttttaaggttttaatagctgtgatttgctctttttctttggtatattttgcagtcatttcatcattcttttcttttaatcctgcaagctctttctctaagtcatctaacctattttttgaaccctcatctttctcttttgacaaggcttctttttctatttctaacttaaatatttttcttcttataacatcaagttctgttgggagggaatctatttcagatcttatcatagctccagcttcatcaattaaatcaattgccttatcaggcatatatctatcttgaatatatctgtcagaaagctttgcagcagctactattgctgaatcatgaattctaatcccgtgatggatttcaaacctttcttttaatcctcttagtattgcaattgtatcctctactgtaggttcatctataattactggttggaatcttctttctaaggctttatctttctcaatatattttctatattcatcaaaagttgtagcacctatacaatgtaactctcctcttgctaataatggtttaattaaattaccagcatccattgctccatcagtcttaccagctccaactattgtatgaatttcatctatgaataataatattctaccctcactgctttgaacttcttttaataccgcctttaatctttcttcaaattcacctctatacttagctccagcaatcaaagatcccatatccaaagcaaatataattttatccttaaggccttccggaacatctcctctaactattctttcagctaatccttcaataattgctgttttaccaacaccaggttcacctattaatactggattattcttggttctccttgataaaatccttattgtccttcttatttcttcatctcttcctataacaggatctaacttatgctttttagcaaggtcaactaaattagttccatactttgctaatgcgtcatatgtcccttctggatcttgcgtttcaactctttggctccctctaacttcagaaagaacttttaagaaattatccttggttatattatattgctttaatattttagaaacttgattgttatctatttctataatagcaagcattaaatgttcaacactaacatatgaatcttcaaactgtttcgaaaattcttcagctttaattaacacttcctctacttttctagttatatatacattgccaactccttctcctaaaacctttggcattgcatctaattccttatttactgacgcttttaaattctttactgatatacctattttagtaagaatattaggaactaacccgtcctcctgctctacaagagctgaaaaaagatgaattaaatctatttgctgatgattaaatttaacagctgtaacattggcatcattcaatgcttgttgaactctcaacgtcattttatcaatattcatacttattcctcctaaatctctatgttaaatttcgaaatcattattagaactagtttatcactatacctgaataattcctctttatctatataataatacataggtcaaagaaagtcaaagtttattcagtcttttttttaaatttttttatcatctaaagatttattttaaattttgttgttttatagtaaaatagtaatataaatattattagcctgttattttacagcttaacgatattaaacttttttaaaagaggtgatgttatgaaaataagttctatcattaaaccaaatttccatacaattaatgtaaacgatactatagataaagctttagattttatggacaaacttaatattaatggaatgccagtagtagatgataaagaaattgtagtaggaatgatagtaaaagctgatatatatagattcatgatacatccaggacattatgttagctgtccagttgagtgggttatgtcaaaatcagttatctctgcgcaatctgacgaagatctactcactgtagctaagcgtctaagagaaaatgatattataacaatgcctgttattgaagacgaaaaaattgtaggagttattaatatagatgatttattagattacttcattgactcttgttcaaaaaattagtaacaataatgtccatatgaatttaatagcttaaatatatcattactgatcttaaaggcttaattgtgaatataaaaaaatagaagtggcgatattttgttaatccattataatcgaattaacaaaatatcgcccttctatatatatttacgagaaattagatttttttatcaacagctaatgcaagattaaagtattttagcgaatccgctgtaagtccaagcttataataaagcttacccatatctacatatctatttcttctttcttctctggtaccaaatttaaacaacgaatctaatgatagattcatatatttttcggcttccaaatgtttgtccattttctgaagaattatacctttaaaataatatgacttctcaattaactttatattatcagtcataatatctaaatttaatgattcttctgtaatcctataagctatctcatactctgaattatcaattaatattcttgtacaataattcaaaaactccacatatttttctacattatcttgtggaaatatctttattccatcttctatttcagagattgctttttccttttcttctacttcaaaataatactttccataatttccatgagatgctgccagagaaataggattatatttttgatattgaaatgctttcattttatattcatcaacataatcttttttaagcttaatgcatactgtagcatatatatgatatatttttcccttgctttcatctgttttaaggtcatcaacatatcctatgatttctgataaaatgctatatgcttcttcagattttcttaaattctgataacacagagcctcattgtagcctattaaacagtactctgaactatcaaatccatcttctttcaatctaaacatttctctaagcttgctgtagtaagaaatagcctcaatatattcaccattttgagataaataacgtgccatatctttaaagtagatagctgtattttcttccgtattatttctttgatataaatcataatattgagaaactataagctgaatattttcaaccttattttcttctacataatacgagaataatatgtgtattaattcaaaagctaaatcataatatttatattttagtgcatagcttaggttatctttcaacttactttcagaatcagtatcggaagatacattcctctttattatatttagattatttgaaatttgttcatatacgtcttctattaaataatctacatctatttctatcttctcagctatataattcagtaattcggtatctgccttaatctttccattttctatacagctcatcttggcaattgaaatcttatttccgcataattctttcaatgttatacctttaaatactctagctctttttatcttttcgccagtagatagtatttccaaatatctcacccacttacttataatttgtaattttctaacttttctgcttcatcaaataactttattccttgatttaagtaatatgaagcctcttcttcttcttttttatctatgaaatattttccgactctcatagctaattcagcagccttcgacaactttccgctattttttgctagcacatatgtatcaatcaatacactttctgcttgttctggtttatcgtcaatattgaacatagtatattttattagtttacattcgatttttctgtctatatcatgctcttcaattctattttctatatcttttagtattttgctacattgttcagtattctttaacttcagataacttttacaaatatctattagtatatcatttatacatcctacacgattttgtgtactaatactttttgatatatcataatgcttaagagattcatctaaatttcctagttcataaaataactttcctaaattatgttctatattaactatgctcttgttatactgtatctttttatatacttctaatgttttctttgaatactttattgcattcggcaagtcaccttttttattaaattcttctgctaaagagaatagatttctcgcataatcttcatcattatagacttgttcaaatctatttcttgctagacaagaatattctaaggctaaatccagttcttctacatcgtaatatgttctagccatattgtagtatatttctcccattaaaaattcatctacaaccttattgtctatatataccttttcagcctgttttaagtaactgctagaagaatgatatgcctttaattctaaagcaatattagctaaatgtaggaaagtttttattatctgctcataattattattttttacaaaaattacatttgctgataaaaaaaacttctgagccataggaaaatctcttttatacatgtaggattttgctgttataaaatatatcattgcttttctatattctagattatatttttcacagtagtatagagcattatcaatatatctttgacctttttcgtaatctccctggagtatgcatgattcccctacctgttcgtaatataaactaatcttttcagcttggctttcttctgattccattaaatattctacatttgtgttcaatgcatcagctaaatattctagcaaatctactgatggattcgaacggccagattctaccaaacttatttgtcctggagttattctgtcttttgccaaatccttcaacgtcatattcaattgttttcttcttctcttgatcttttctcccaatgatagaatttccatctttttaatccttctctattcaacaaattatttagttattttaatataatttccttaattataacataaatttataaaaaactgcataaaaatataaatgtgccccaaattttatataatttaattttattatccatatttatgtacaaaagtataaatacaataaataaaaataaaaaggcatgaaagaaattcatgcccttctatttttgttatacctaatttttacatattatactttctttttgtaattctatctcatccaatcataaacttcatgacctactgattcagccatattcctcattcttctgcctgctcttctcattgttttttgactccttctatccatacgtggcattagagacatttcgacagcaactccaattaaaaatccagtcatcattcccttagaaaatctttccataataaacacctctttaacatcaatttattttctataaatatattgtgtattaatcaaaaagttatccaagttaatttattccatgattatatacagttttaaaaatattctaaaaagtaactatgcatattacaatcagctttctatattccagtcctaattaagcatttttcttatttgcattttaaatgcaaatctattattccaacatatatactggtttaattattatcaacgtactctttaagaagataaaaaattaatttttctttttctttgcttaatagcttagaaattatctttttgccttcgatagcgttatttctatataaaccaataatttgttcaaatctaatttcattgtcatctttcttatctacattcaatatattttccatttgtagattttcatcttcgccaattaaaattatattatttgaatgacttggagctatgcttaagatttcttctttaaccttagtaccagaaactcttataacatttttacttaaccatttttcaacggttctatcagaagttatccctaagcactctttacatttctcatcaacaagctcgttaaataaatctccagtatgactatcaacttttacaaatataatttccattccagaatttattaactcttgcatctttttataatattgcatagatgattcttcttttcgttcccatgctccagttgcatgatgagctatcccctcgtaatcatgaaatagaactacttttttttgtccatgttctaaagcatattcaacagctctaacagctcccttaagttcgcctgctatttgtcttatatttttagaagagctatctttttcagctccgctttctatatattctacaacatcatcattaacacaaactaccccataagaatatcttccgtcagaagaattataacttccatcaacatatgcatgaagacagtcttttggataactttcatcactcttttttagcattctatttccttcgtttagatatgattttgcctcttctatgtcttcgaaactcttatactttgctccctttaccccttttacatatgctaagcattcattccaagtattgactattacattttcaacctttttgttatttttaatatcaaaaccatattgtattgcataaacttttttcgccatatattattcctttctccgaccgtctaacttattattatacttttcatggaatatttataaacttataatctatatgttattaaatttataaataatattttctatagtgatgataattcttctacagcactatataatttttcaatatttgcagcatttgtaaagttagttagatattctattcctttttttaatactaaaagtatatcatttttaccttcccaattctctactattatcgataatggtatatctttaataatcttatttaaaacaaaaaatataactccaatatcatcaatcacacctataaatggtatactattaggtattatgttaactggtacagttacatatgctattcctgccgacattataagcttagtctttatagatactcttttatccttaagtaatctatatattaaagaagctatatctggcaatacaaatatatactctttataatttctcacatttccagataatttatttgtaattttatttcttccgacagaatagcaatctttagttttatctataagatccaatgatgctacatcaatctcttcttcttcacttgtttcttcaatatcactttcctttattaattctcctagtattgaaacctcaacattagaaatttcagcccatacctctgattttttcatgaagacctcactaatatttagatttatgtatggtacatcttgaagtattgtatttatatcaattattactttatccctatcactatctattccatactttttaaaagcttttgctaattgctttatcacaaaacttcttaatattctaagaaaaccaacatttaatactttaactttaactatctttacagtaattttgttatgaacacacccaactaattgaacctttatattaaagtctatatttattccctttttcaaagttccttctaatattattccatcattaatagttactgttcttaaatccaacccatcaaccttaacaaattcattgattatacttaatatatcattaccagttaatttaacttttacttctgatatgttcattttttattcccctttagagtaaattcttacttttatataaattaaatcaaattattttcctaaatatacttaaaagtatacattattccagaaaattattaaagatatgttatatatagaatctacaatttttcttaatagcaaaagcccccatttaactttctgataaaaaaagaaggcatgccttaatgtcattttgttgcctaaatgacatttggcatagcctctcttcttgtaatacagcatattcatgctgcaaatactagttattattcaatttcttttttcaatctatatgttcaaaatgaactattaaaatactggaattactgaaccattgtattctttttctataaattctttaacttctggtgatgtcatagcttttactaaagctttgattttttcttgattttcattaccttgttttacaacaactatgtttgcataaggtttagcagcttctgaagccttatcttcaataataattgcatcttttgctggattaaatttagcttctatagcatagtttccattgattactgcagcatcaacgtcatctattgctcttggaactgctgctgcttctaattcattaaactttaagtttttagggttttcagtaatatcctttgatgtaactagttctccatctttaatttttattaagccttttcctgctaataattttaatgctctagcttcatttgatggatcattaggaacggcaattgtagctccatctttaagttcatctaaactttttaccttcttagaatataatcccattggttctaaatgtattgcaccaactgaaactaggtgatatcccttagatgaattttgttcatttaagtatggagtatgttggaagaagtttgcatctaatgaaccttcttctacagcagtgttaggttgattgtaatcattaaattctgttatttctactgtatatccttctttttcaagtaatggtttagctatatttactatttcttcatgtggctttggtgttaccccaatctttattaccttgtcatttttagaatctttacttcctgaagtagctgtgcccccgcaacctactaatcctagtgtcactactcctgctaaaactactgataaaattgatttctttttcatatttattccccctattttgataatttattgtaaaaataattgcctataagctgtagtccttgtactactatgattaacacaatacatgttactaccatataatcagtttggaatctttgatatccatagcttatagctacttgaccaagtcctccacccccaatagttcctgccattgcagaatatccaacaatgcttattattgtaagagtaattcctgatgctattgaaggaattgcttctttaagcattaccttaaagataatttgagtgcttgatgctccaaaagatcttgccgcctctattattcctttatcgacttctctaagtgatgattctataattcttgctacaaatggtgctgctgcaattgtaagtggaacaatagctgcttctgtacctatagatttaccagcaataaatctagttaatggtattattgctaccattaatataataactggaaaacttcttaatatattaattattaaatctaaaactgtataaactattttatttggttttaatccgtcttttgcagtaactgttaatattattgcaggtatgaatcctaaaataagtgaacctatagtcgatgcaaaaaccatctctagagtttctattaaagcttttactattacctgattcattattcgatcacctccaataagatatccttattttcaaggtactttataaccttgtccttatcctcttcgttgatgtttattacaagcccacctaatacttcgctcctaaatttttcaagttttccccaaactatagaaaaatctatctctaattcccttgccatctttgtaattagtgcattttcagaagaatcacttgggaagaatatcttgatattaacaccttcttctggtaatattccttcatcttcttctcctaagaatttctttaatgattttcctggttgtaagaataaatcttctgatcttccttctgcttttatttttccaccatctagcaatgcaactttttcacaaacttcttttattacttccatttgatgagttaccattactattgtaatccctaattctttgtttattttagaaagtaatgctaaaatgtcttttgtaattttaggatctaatgcagaagttgcttcatcacaaagtagtattttagggtctaacgctaatgcccttgctattgctactctttgtttttgtccaccactaagctctgacggtttgcttagctttttgtctgttaatccaactaaatctaataatcttaatactttgtccttaatttcacttttgttgtacccccacacttcaagaggaagagcaacattatcaaaaacattttttctttgcataagattgaaattttgaaaaatcatccccaaatcttttctaaattccctaagactttttccttctaatgatgaaacctctttccccattacatttattgaacctccatcataagattcaagtccattaatgcatcttaatagtgttgactttcctgctccgctgtgtcctattattccataaatttcgccctctttaatgcttattgatacatcttttataacttgtgtttccccaaaattctttaccacatttttgatttctatcaaacacatttcctcctttgactttgttttgttagtttccggataactaaggtgatgtaataattaacttaattattaacgttcacctcaaaacaaaagcgctagagaataaatctctagcgcataaaacaccatacaaatttatcctctcatctatcagctaaaagctgctggaattagcaccatataaatatcatttagtaaaaaataatacttcggttgccgggtttcaaagggccagtccctccaccgctctcgataagatattcagattatttaatttagctttgacctaattatatacaactttttttaatttgtcaaaatctatagaataaccttttgctctttcaaatccaagtattgtaatcggattggttttattatatatactttctgcatatattgcaagatttttttatgaaattaattaataaatttaagtttatagtataaatattaaattattttatatttatattgttaaatctgttgtatatgctatatatttctatcaaatattcaaaatcaatatctaggctaataaaaatatcagtataagaaataataaatattcttcaatagaatttgaaaccatacacatgtagataaatctatctatgtgcatggcttcatttttaccagaatcacttatatatatatttatttatgcctgaaaataattgcttcagatcttacgctgcttttttctgtttatctacattcagtatctcccaattatttgagcaatctggagatatctctccatgttttttaatgtagctagtcattagacttctcacttgaccatcatcaccaagtgcttttcctgaatcatagacaataatacttgaatcagtattacttaatccagcggccttcataaaacctccaccaccattaaatctataattgtttatagcaactgtaaattcatctgaatcttttacttcgacaccattaacctttaaattctttattctatttcctgatattactcttcctgtttccttgtcgatagtacatgcaggttgtgttaaatcaatatcatatgttgcaccatataattgatccaagttataatctggaatatttaatattggatcttttattactgctgcattatcccctgttgtttgatcataatatctaactgaatattccatccagtctttcaattgctttcctgtcatttttactccatacaaaaagttttcaaatacatatactgccatcatatcttttattgtaacatcgccttgaggtatatatgctccagaacttaatggtgccgcaattgataattgagtcccagcactttctttttgtactttattaatgagctccataattgcagtaggctcagttaattgtccacttcctgtaaattctccggttgaagttcctatttttgtatctacatattttaatgttgtatcttcataaggtttaattaaatcgacaatctcctgatcatccgctatgctattatcaataacaatgttttttgttgaaattcctataagctttgcatttccatcaaagttcatatccacttgtgccaaacctgtagctcccttagttgactcaactattggaacaactttaccttctggattcttcttagttagatcatttactttcaaatgtgtgtgacctgctataattgcatctataccatcaacttgtgttgctattgcgttaatttcattttctggtataacatctgcatcagtctcttgaccactatgtgctgaaattataacaacatctgcgcccttggcttttacttctttaacccactttttagattcatctacaagatcattaaataccaatccatcgtaatgttttttatcttcccaacttggtatgcatttattttctaaacctataaccgctacttttacttctttaccattaacataaaaacttttcattatatatggatctacaaaatttgttgaatcgttcttatatatattggctccaagtacttctattccttctgacttatagtctttaatcactctatttaatacatctaatccataattgaattcatgatttcctagtgtccacgaatcatacttcatagctcccataacctttgccatagggtgctctaaagtagtgtctaaaatatcatagtaatatgatagtggtgttccttgaattgtgtctccattatcaattagcatcacattattattattttctcttacacttttaacatatgatgaaactttagctaatccctgtgctttagatggtgcttttcctgttccataatcataatttaaaactgtaccatgaacatctgttgttgctaataaagttattgaactagacatattaaccattcttggtatatcagtattaggtattgtatttttatcatttttatctttattttctttacaccaatctataaatgcatctcttactaaaacatgagtatcatttttaacatctaatccaccgtactttgtaaatgcagtaaacgaatctcctccttgagccacaaaatctggaactgcaacagataaactttcgttatcactaataggagttccatcttcttttgtgatagatttaactctttgacctgatggaagatttgaatcatagccgaatttaattcccgatacctgtaaccccttactgttatccgcaacagcctgctctagaacttcttttaattgagattttgtcatgcttaatttataaattgtgttatcaaaaggcatgaactgccacatagttccgactgtaatatttccttgtggaatatctattctaagacctccattattttgaaatccaacatcagctttaatagaatttcttgtaacgtcagatgcccaatttcctaaaactgatgatccatatggagaagcatctaattttcttgttaaatccttttctgtattatacccaataacttcactcgtcattggctctatctgtttattggcattatctacaattttatcaacatcactgtctgtttgtggtgttccagttttatatcctttgtcattatctagcgccacataacttgtttcaagatttggctgatcaaatacgattttattatcactagtcaccttgaatttagcatctatatatcctttaccgtttgatcccccaatatatactgggatattggtattcttagcaattgcagcagttttagtatggctatgtccaccaaatacagcatctacattctgaaggttattagctaaatcaaatactggccctgttgcattatcacccttatcaccttcatgcaccaatacaattactacatccgccaatttatctttctttatttgtagtgcaataggatttatttcacttgcaaggtctgtaaatttatagtcactcacaaatttaggtgatacactcatctctgtttctcttgttattcctcctataacggcgatttttatgccatctttagttataattttatatggatcaaatacacgcttgccagtcttcttatcgtaaagattgctgcaaactattgaatacgctgcacccttcattgttgtatttgtagttgtatccaatccccaatcaaactcatgatttccaagagttgttatctccattccaatcttagacatagtctcctgaacaggaacccctttcatgatattagatgttgcagacccttgatacaaatcacctccacctaaaatcaatgtcctatctttattagactctttcactttttctattctatctgctaaaacccctgcaacttgatttcctgatgaatcattaagtgttccatgaaaatcagtgatttcgataacgtcaaacattttttcattctcagttgcataaactcttatagaaaacgagctaaataaagtaattatgaagaataagctagtaaaaattgatataacttttctgaactttagaagttttttcacaattatttcccccttaatactaatctcatttacatattattacttacaaaaaattatatgacacatatttttgtaatagtatatttattgtaaatgtcacccatttattattcagattatttctataataattttatctaaaaaccccatattatcttgtattttaaccaaataaaaaactaccaaaaatatttttatactttcggtagcatgcttaattaatatttattcttttccttaattgctctatccatgtccctcttatgagctttttctaacatcgagtctctcttatcataatttttcttacctttacaaactccaagcgcaactttaacttttccgtccttcaaatacaatgatagaggtattaaggtatatccatctctagacactaaaccatcaagtcttcttatttcatctctatgaagaagtaattttctctctcttaatggatctacattaaatatatttccttgttcataaggagatatgtgcatattctttacaaatatttcaccattatatatatctgcataacagtctttaagattcactcttccatttcttattgatttaacctctgtcccaactaaaaccaaacctgcttccattgcctcttctacaaaatagtcatgccttgcttttctattttctgctaatgaattctcatttctttttcttgccatcataatcacccgctatggttatatttctactaaaattatattatacccatttctgtaaatcaacttattttgaacattgctgatatgaacgctcaaaataagtttatatgcacaaatttttgctctttcagaacattaaaatcatatcttatacttcaactaactttttttctacttcgctaatttttccttctgattcaaaatctttatctgtttcttctctctttggctcttgtgtaatcttaaaaaatatctctctatttgttatatctacattaacgcattctacttttactttatctccaagtttatataactttttagttctttcaccaatcaagcttaaatttgcttcattgaatatataataatcatcatctagatctgttatatgaactaaaccttcaattgtgtttggtaactcaacgaatattccaaaagatgtaactgaagatataattccttcgaattcttgaccaattctctcttgcatatactcagcttttttaagatcatcaacttctctttctgcatcttgagcctttctttccatttcagaagattgtttagctgcataacctactatattttttaatttatttattctagttccatctacttctccatgcaaatattcttttatgattctatgaatttgtaaatcaggatatcttcttattggtgaagtgaagtggcagtagtactcagctgcaagcccaaaatgtccactacattctggtgcatatcttgcctgcatcatagatcttaataaaagtgtacttacaactgtttcttcgttttttcccttaaccttttctagaatctcttgaaaactttttggtcttatttcttctgtccattgaatagcatatcccaaattataaacaaattctttaaatttagctaatttttcttcatctggactctcatgtattctgtatacaaaaggtagatgagtaccaaacatatgctctgcaactgtctcatttgctgctaacataaattcttctatcatcctatttgatatttcacgatcatacggtttaatctcaattggttttcctaactcgttaagtgttatcttagcttctgctatttcaaaatcaatggcacctcttttggttctcttatttcttaatataccacataactcttccatcattttaaagtcatcaacaagatagtcatatctttttataagttcctcatcattatctcttaatatctttgtgacatctttatatgtcattctctcattagtttttattacagattctacaatttcatggtctacgacttttcctttatgatctatctccatgaagcaagttaatgttaatctatctactctagggtttaatgaacatattccattagataattttctaggtaacatcggaacaactctatctattaaataaactgatgttgctctttttaatgcttccttatctaatggactattttcttttacatagtgtgttacatcggcaatatgaactcctagtttaaagttgccattacttaatttttcgatagatacagcatcatctaaatccttagcatcttcaccatctattgtgaccattctcaaatctcttaaatctcttctgcctttatattcttcttcatcaatttcatcagaaataccttcagcatacttttgaactttttcactaaattcttctggaagtccaagttttttaattatcattagaatgtctattcctctgtcaccttttcttcctaaaacctctgttacaactccttcagcttttctattttcctcaggccattttgttatcttaactgtaacaacatctccatcattggcaccattcctatccttctttgagatgaatacatctttagatatccttggatcctcagaaactacaaaaccaaaatttttagaatcttcatatacacctactattctagtagtgtttctttcaataatttctactacttctccttctcttttcttggtctttgtatcttctcttgttactctaacagatattttatcaccattcatagctccatttatacaattgcttggtataaatacgtctttttgtccctcttcttctggaattaaaaatccaaaaccttttgaatgtgattgaagcgatcctataataagaccttcttcttcatgattcgcattagctatcatatacttgtcttttttagttcttataataagtccttcattttccatagttcttaaagtctttttaaacgcattatattcatttttctttatatcaaatacagcaattaactcttcaatgtccattggcctatatgcaggttctttcataaaacttgctaatgtttgttttattcccataatttcttcctccattatactattactatattttattcctatatacctatatactaccacaataaccttgtacaatatagattttatcttattttaatattagtattgacatatatattctaatttatttatatactatagtttagttaattaaaaaatggcaatatttgaattgtttatattatgttgcaataataaatttaatttaaaattctgttactccaaatgctaaaataagtctagtaataaaaaattcaattaaaatatacatatttaggcattacttaacaaaaatagatatcctcttttatcaaaaggatatctataaatgacttcataattaaactgtttaaattttaaatatacttaataattcgtattattttcttaaacttttttacttattttatgtttaaagatttttacaatgaaatttatgcactagcgctaattgcagtagtataaatcttctctaataaattaagcgctcctttatatccaatataagttcttgatagtactacttcataagaggctggaaaacctacttcaataattgctccatttaattctttagctgtatctctttcccatgtagtaccaaatataataggcggcttatgcccgaagtctgtctgtcttagcaattgtcctattacatatccatcctctgcaaaatcaacatctgcagatacatcttctgctaatttactatactcacccgcaattgctcttctatactgctctggaggattttcagtaataatttgtttagccggaattaatcccagctgatttactaaaaatttatttagagctaaattataagcgctatctcccactactgcatatttagccggtaagccccaccaatattcagcatagaaatctgaaaagtgttctaaataatagtagtaatttttttcttcatcttttataaaatcttcacttttttgtttatctattccggagaaatcaactactttacgcaaaaatgcacttgtttcctttgctccaataggaacagtagggatgtgtagaaatggttgttcatatttattttctagatgcttagcagtgtctaagccaagccaaggagagagcactaaattaaactgtgctttaggtatatctctccattcgcttactccttttgattctggtccaaatagaatgtttgctttaagccctgctccttcaagtacacgttttatttctgtgagatctccacgccaaaatgtattttgatatggcaaaagcgaccatacattaactaaccctttttctttttctccatcatattctccaacatattgatctataatagcctttgtaactaattcgtggcctataaaattatttcctttaaatccaccagtttccgcatatacaacaggagctccttttttctgaaattctccaacaactgctcctacatcatctccaacaatttcacctatacatccagtaagaactacaaataattctgcatccattatctttaaggatgatttaatcaattctctaagacggttctctccaccaaatacaacctcattttcacctgcattagaactcggcgatactgctccaccactatatcctcccccttgaaaaccattataaaatgcgagaccagtatactgcttatctgcacaaccaggaccacaatttacaataggcattgctccaggaattgatgatacactgtaaatagctcctatagcgcaaccataacgcacttgatttatagaatttgtttgagtaatatttacgtctttgttaatctccataacttcctcctttaaaaaatatcaattatattattttttcatttaatatttctggtttttttgcaagaatataaggatcctcttgatcaagccaccattgggtataaggcagctttacatggtcttttaggtcttgatgaaatttcctatgggcgagtacatccaaaacagcttctcctaaattaaccattccatcatatccaatagcaagatgttcatctccgagtggagccgctggtattcctaatctggatgccaatggtgcgagcccattatgccttattaatatgaagtctggatttgtcttttttaagagtccataaaattgatattgttgtctattacttacactaaatgaaggtacatcatcataattatctattaaaaatttaagagaatcctgctttggatctccactatcataaactggatcatgatgaaatactaaagaaccatttacttcaactcctagttctcttaaaacaataattaaaccatgagcataagctgaaccagttgcaacatatccttttacgcctttaagtttttccctaagttcttttaacttaggttttattctttcatgttcttttttgataaactcttcagcaagttcctctctatgagtgactcttgctatttcacgaatccaagcatctgtacctgcaaagccataaggttgaggtgcctttatttctggaaccccaaattcttgttctaatgctgctgccatatacgatgacaaggtatagcaaaacccaactgttcctgctgcttctgaaagttgtgcaagatcatctaccgttgctaaatctacaacataatttactcttaatcctagctctcctaacattggtgtaaatacatcagatccccaaagatttataacattaattaaatcttcctgctttttaggatttttacgtacaatttttctaagaattccatgttgagtagcatcaaaacctgtgctccaatgttttgatctaaagccttcacaggcaagtggaattacaggtattccaatttcatcttctgcttccgcagccacactctccatatcttctccaatgattcctgtcgcgcatgacgtacctaaaaaaatcgccttaggactatacctttcaaaagcatctttaattgattgttttaactttttaatacctccaaataccatgtcactttcatctaagttagtacaaataattcttatgttttctactggtaaattccgaagtgcaagtccatttcgataaattgaattataaggtacttgtcccactccgcaaccaataggtgaatgttgaataagcactgcatctcttacgtttccagcttgacattcaaccatctgttcgctacaaactgatccttgtgtaaagggtcctttcatttcacaaagtctgcattgtttacctctgccctcgcatcctctgcgttcataagaagattgctctgatagttctgatgcctttccatcccatgcaataatagttccaagtctttgttcacgactttcaacctctggaatatccagattgatctttttatatgccatatcttttatccctcctaaaattttattttatggacaataaaactgagtctcttgcatactaaataatgtataatcaagaaactcagtctctagttttctagtcaacttcgttaataaagttatcatagttaagttttttcccatccaaaatcaaaatcttgtccttatactcttatttccatagcttattaatttatttgcattacttagtcatcaaacaatgttgtacttaaatatctatctcccctatcaggaaaaacaacaactatatttccactatcgatttcctcagataacttcaatgctgctgcaagtattgctccagatgatgatccaactattaaaccttcctttttagccagtaactttacattcttaaaagcctcatcatcattaacctttataactttatcaactaaagatatatccattgttttaggaacaaaatcatttcctataccctctattttgtaactcttatgctctccaccgaccattgttgacccttctggatctgcgagtactcctttaatatccttatccttttcttttagatattttatgattcccgtaaatgtgcctccacttcctgcacctgccacaaaataatttatattcccatctaatgatttatatatttcagggcctgttgtttcataatgtgctagaggattatctttattttcaaattgtcctaggctaatgctatttggaatttcttttaataattcactagctttatttatggctccaagcataccttcttcatccggagtattaatgattttagcccccaaagctttcattagcttttgcttttctattgaaaatttggttggtactacaaagattatattatagcctctattaattgcggcaagtgctataccaagaccagtatttcctgctgttgcatcaactattgtatagcccctctttaagcttccatttctctcagccccctcaatcattgttactccaattctatcttttatacttccaccaggattaaaacattcaagtttagcaaatatattaacattttttttaacattgatatgtgtgagttttataagcggagtatttccaataagttcttttacatcacttacataattcatatcaaactctccttaaatgcattgtttaagtcctcaattagatcatcaatattttctatccctactgacaacctaactagattatccacaattccaacctcctgccttattttatatggaattgctgcatgtgtcatgctagctgggtgacatattaaagattccaccccacctaggctttctcctaaagttataagtcttagtgaacttagaaactttttgtaatctatcttttcatttataacaaaagacaatactcccccaaagccagatgcttgtttcttatgaatttcatatcctttcgaatcctttattcctggataataaattttagttatatattcactttgtgataaaaattgtgctattttctctgcattttcattgtgcctatccaatctaacacctaaagtttttatgccttgaagcaatataaacgaatcaaatggtccaagtactcctcccgttgaattttgtataaagtgtaacttgtcccaaagctcatcattatttacagctattaatccagctactacattactatgacctcctaaatacttagtagcactatgaacaacaatatccgctccaaattctaaaggtctttgcaaatatggtgacataaacgtattatctacaacagtaagtgctccatattcctttgcaagcttactaacctcttctatatcagtaatatccatgagcggatttgttggagtttcaataaaaacggcctttatacttgagttgtcttttccattttctaaaattctttttacatcatttagtctagaaaagtcaactatctcatattgaagattaaaattcttaaatactttatcaattactctaaaagttcctccataaagattacttggaattatcactttgtcaccgctatgaaataaagataaaacagccgtaatagcagccattccgctgctaaatgcaagtccaccgcttccactttctaacaaggcaatggttttctctaatgcttcccttgtcggatttccagtccttgaatattcatatcctttatttttacctaactgttcttgcttatatgtggaagtttgatagattggaacattcaccgatcctgttgtctcatccccatcaattgcaccatgaactaataatgattctattttcatttttctctcctcctcaaggtttcgctagtgcaaagttttctacactattctttatttcttatatataaaggttgctactatttctaaatataaattactatatattactcatattattcttatttgtttactgtgttttaggataaatgaaatatttatattttatttatcttaacgattgtcattatgaatccttaataattttttaatacttgtttctattcatattaatcaactaatttcctatccatgagagaaagtttcaacaacttctttatcatataattgaccatgtatatcttgatttttacctggaactccacaggcatcagctctgcaatgtttgcagtgcctaaatacatcaagatattcacctgcttctcctctacatttatcaagcattaggcatgatggcgcttcaagatgagaaagttcgttttgtggtattagtggaattatatttaatattgatgctcctaaccccttagttactttagctatctccttgatatgtctatcattaattcctggtattaagacactatttatttttactataactcctaattcgctaatctttttaatacctctaagttgtgcatttattaacttctttgcaccttcttccccttctagtcttttaccatcttcatcaattacaaaagaacatatatccttttgaatctttggatcaatggcattaacagtaacagttattgtctcaaccccagcttcaacaatcttttcagccttttcttccaatcttaatccattggtacttaagcagttaataagatgaggaaattctttttttactaatttaaaagtctcaagagcatgatcagttacaagcgtatctcctggacctgcaatccctacaacactaatttctggacataacattaatgccttcctaacagtttttacagcctcttctggagtaagtagtaatgaacttacacctggacgcacttctgatttattaaatccccttctacaaaacttacattgtatgttacatgagggactcactggtaagtgtatcctcccatatttaaaatgcgcctccccacctaggcacggatgagtttttacaaggtggtcaaaattccccatatagttcacttcctttattctaactttgatcaaaatttattcattatccaaagtttaattttataatctaagtcctaatttaattgaattctttaaatactatttacttacttgaatcatacttataacttagattattaatataaatctaaaatatttacttttgaatttagcactttttttagtatatcttctataaaataaggtgcctcaattccttttattcctttcgcctcaacctcagctaaggctccttgtccaattctcgctacaaagactgctttacaatcagatattaattcaatagatttacttaaagcatcctcagtgtgctgaaattcttggcacgatggctcattaaatcttgtctctacatacttatattctttatcatccacttcaacaattaagaattgctttgttcttccaaaatgttgatttacaacttttccatcactgcttgcaaatgctattttgtatgacatatcttcctcctctttaaaatgctggaactaccgcagaaccatatttttctttaataaagtttttaacatcatctgtagttaggactgaaataagtgccttgatttcttttctatctttatctccttttctaaccgtaattacatttgcataaggagaatctccatcttccctaagaattgctgtatttggatcaattttagcatctaaaattatattagtatttattactgctcccgctaaatctccaagagatctaggtaattgtgctacatctgcctctacaaattgaagatgtttaggattttcagctatatcatttggtgtcgcagaataattttctaatccactttttagtttaattagtccatttttttcaagaagaactaaagctctatattcatttgaagggttattaggtatacctatcttatccccatcttgtaaatcatttattgatttaagtttattagaatataatcctatgggctcaacgtgtatttttcctgccacttcaaagtcgtatcctttttcttttgatacagactctaagtaaggaacatgttgaaaataatttgcatcaatttgcttttcatccaatgccggatttagctggccttcatcatcaagggtcactatttctaagttaataccttgttcctttagttttggcttaatatgctctaatatctcagcatgcggtgttaatgctgcacctacttttaaagtcacttcgctcttttcagttgttgttgatgcacttgtagctttgcttgcatcttctttgttagctgagcatccagcaaatactcctactaaaagtaatccacttgtaattattgataataattttttcttcaatttaatccctccatatttattcaaacttaaatctcttcttattaattgactttgcgatgagatctccaataagctgtatagcttgtactataataactagaataactacagtccctataagtacatctgtacgaaatctttggtagccaaatcttatagctaaacttccaagtccgccagcaccaattgcacctgctatagctgtaaagcctattattcctataattgctatagttattcctcttacaattgaaggaagagcttctggaagcagaactttttttattatatcaataggagttgcacccattgattctgcagcttctatttttccaaattcaacttcctttaagctgttttcaattattctcgcaataaatggagctgaacctattgaaatagatactatagctgcatttgcacctaatgtggtcccaacaataaattttgataatggcaataatataattattaatattatttcaggcgtggatcttattacattaattaagaaaccagcgattttgttaactttatataaaggaaaaattccgcctttatccgtaacaaccaataatactccaattggcacacctatcaaaaaggctactatggatgaaagcaataccatatataaagtttcctctgttccaactaaaagcaatttaactaaatcattgctcatattccttcacctcctgaaaatttcccattattttgaaatccctttgttattgttataaatttctttaaagtatcacttttaggatttaaaaataagttttctgtatttccctcttctactatatgaccatcttctaaaactaccatattattagtgcaataccttaacacatctagttcgtgtgttattatcactattgttaagcttaacctttggtttatatttttcaaaagttctaaaattgaaaaggtggtttgtggatctaaagcagaagttgcttcatcacttaaaagtacatccggatcattagccaaagctcttgcaataccaaccctttgtttttgccctccacttagttgaagtggatatgaatcccttttttctgacaattcaactaattctaatatctcttcaactcttctctttatttcctctttcttatatcctgaaatttctaatggaaaagcaatattttcataaacagtttttgaatcaaataaattaaattgttgaaatatcatacctattttttttctagcacttcttaattcttttccatttaacttagttatctcattttcaccaatgattatattaccagaatcgggtttttcaaggccatttaagcaacgtattaatgtcgatttacctgcgccgctaaaaccaattactccaaatatatcccctcgcgctatttctaggcttatatctctcaatacttcaacttttcctgttggagtattaaatgttttacttatattcttaacagttatcataaaattgcctcccattacctcgaatagtgatgttttaagtcttcctattcattataatatgtctaaaagattttaaactaaattatataatcctcatctaaatccattaatccatattctattaaaatttcttcgagtctgtcttgagtcattggttttggaattacaaataaatcattttcttctatctttctagctaattctctgtactcatcagcctgtttatcttctgggttaaactctatgacagtcttttttcttatttcagctctctgaacaacattatttcttggtacaaaatgaattaattgtgttccaagttcctttgcaaaagcttttagcaggtcaagctctctatcaacatttctgctattacatattattcctccaagtctaactccaccttttagcgcatacttttgaattcctttggagatgttatttgcagcatataatgccatcatttcaccgcttgcaactatatatatttcttttgctttaccttctcttataggcattgcaaaacctccacatacaacatccccaagaacgtcgtaaaatacataatctaaatcttcagtgtaggctcctaacctttcaagcattccaatagaggttataattcctcttcctgcgcatccaactccaggctctgggcctccagattcaacgcattttatacctttaaagcctgtcttcataatggcttcaagctctatatcttctccttcttctctcaaagtatctaaaacagttctttgagctagtccccccaataataatcttgttgaatctgctttaggatcgcaaccaactaccattacatttttcccaagctctgcaagccctgctgttaaattttgagtagttgttgattttcctattccccctttaccgtaaattgccacttgtcttaaagttttttctgccattgctatattctccttttttataaattattaaaacttatcggcatataaaaatatgaatttttttaattggtcatttctctattttaatatacctaaagtatttttaatctttccctataattagcttaaagcttccttaaatgcttgtcttaaatcattaattaaatcttcagaatcctcaagaccaattgaaagcctaatagtttcttgaggaatttttgctaattttaattgttcctctgttaattctccatgggttgttttaggtacattaactattaaagatcttgcatctccaacatttgcctgataactaaatagttttactgaatttattaatttataaatttgttctgtatttcctttaaaaccaaaagtaaaggttgatcctactcctttagcaaaatatttatctgctaaaaatttatatgggcttccctcgatttcaggataatttatccaggcaacagattcttcatttttaagataatctattatttttcttgtattattaatttgcttctggaccctttcagataatgtttctaaacctattaatatcaaataagcatcaaaaggacttaaaactgctccaaaatatgttagataatctaatctgatttttccagcaaatgcactttctttaaatacatctatataacttctttcatttccctctaaatcttttagagtaaagtacggttctgaaaattgaggataccttccatttgcccaattgaatttaccactatcaactattactcctgcaatcacgtttccatggccacttagggcttttgttgctgagtatattactatatctgctccatatttaataggattaaatagatatggtgttgcgaatgtattatcaacaattagtggaatattattttcatgtgctatcttagcgattgcccctatatcatataatgctgcattagggttgcttatagtttctataaaaattgcttttgtgtcttcttttatagattttctaaattcctcaatatcattgtcatcttcaatcctgtcaatttggattccgaacttaggataaagtttttttaaagcatctacggttccaccatacaattgatgtgttgttaaaattcttcctcccccttctgctactgcaagtaatgcataagttatagctgccattcctgatgcaacgcctaccgctgctatgccaccatccaaagaagctattctattttccaaaacactaactgttggatttccaagtctgctataaataaaaccttcttctgaaagactcgctaacctatcaaatctttctgcttcacctacttcaaaagatgctgttgcatatatcggtactgatacagcatcattatgttcctttggattgtatcctcctctaactttaatagtatcgaacttgtaattactcatctttctccctccaaatttatcaattattcatgttaatttgcattaataattcttataaaaacgctcatatttaaagcctctataaatccatataatcccttttatcttttatatttagttggcttaaatccatctcaaacccgctatttatctataaatatttatatatctttatatttaaattgttatctagatacatatttaaatagttaaatttttttctatttaactatatacatatttaaattctttcatattttcatatttatctataggtgtttagcactctatcatatatgtcctcaattgctctaagcccaccattgtatccagcataaccacaatttaatacaagtctatatgttactggcacactagtgataagcaaatctgcatttaattttgccgctaaatctctatcccagccacttccaagtattaaagccctgccttcttgaaaatctttttctttttccttttctatttccaattgaactgcgccagcatctacattaaattcaacttctgctgatctgtactcagatatgctttcaaattcttttattatagattctttatattgctctggggtatcatcaataataaattgctttcctggaagtattccaagttcatttaataggaatttagaaaatcctaatgaatacgatgcatctaaaatgctgtagaattttctaggcaacccatatctaaactcaagcataaagtccgcagttttttctatatgaaaataaaatttttcttcttctttctttataaaattctcaactttatttttatctaaatgcccaaattcaccaatttgtcttaaaaattttgatgtcgcaattgctcctattggcaagtatggaaaatgtacatatggtgttttatatttattttttagatgttctgcaatatttaatcctacccatgaacttgcaactatattaaactctgcattaggtattgtcttccattcttcaatgccattagattcatttccaaaaagtatatttacttctaaaccaataccttcaagaactctttttatttcttctaaatttccattccaatatggatcttggtaaggtactgttgtaaatacatttacgagtcccttttttactccattgctatttttgaatttatctacatattgatctattattgcattgacaacttcactatgacttacgtaattattacttttaaatccacctgtctctacatatacaataggtttatctccttcttgatattttgacgtaacacttcctacatcatctccaacaatatctgatgtgcatccagtaagtaccacatacaaatcagcatctattacttggaaagctccatcaataacattcttaagttttcgttccccaccaaacactacatcagcttctgtagcattagtacacggaattgtatttcctcctgcatagccttcgccttgtcctattaaagaactgattttattactgcatcctggtccagaatgtagtataggaactcctcgttttatggctattactgtttgctgtgctcctaaagcacaggaaaatctaggttgttcaataattttcgacactattattacctcctaagaaagtaaatggatcttgatctagccaccattttgtataaggcatagtactatgcttggctaaattacttacaaattctctattatcaagagtttcaactattcttgaagcataatttaaaactccctggtatccaaaaccaaattgctcatccccaattaataaagttggtattccaagctttgccccccacatagtcattcctccgtgtcttgcaatcataagatctggttttactctgtttaatatattaaccaattcataggcttgtttattgcaaacattatagtgcttgatatcaccataaatattgactgtttgagctaaagcatccgaagttttatctttattgtcatatagaggatcatgatgaaatattgctgccccttgaactatgagtccaagttcccttagcatggctattattgcatgaccatgagcagccccggctgtaacatatgctattttgccttttagtttttctctatattcttcaagtttaggtagtaccctttcatgctcttcttttataatttcttcaatttcttcctctttgcctaatactctgccaatctctctcatccatatatctgttccttctataccataggctggtggagcctttatttctttaactccatattcttgttctaaagctgcccctaaataagtgctaagggatgggcatatatgaattgttgctgcggcttctgaaatatactctaattctgctacggttgaaaatggtacaatatattgagcctcataacccaatctatttaaaaattcatcaaaaatatgacttccccagaaattagctacattgattttatttgttttctttctaggtggctttactaactttcttaaaattgagtgataagcagcatcaaagcctgttgtccatattttagatctaaacccttcacaagaacatgatataactggtatacctagctcttttgacaaattttcagttatcgcatctacatcctcgcctatgatcccagatgcacaagaagttgtaacaaagattgcattaggttttgttcttttatatgcttctcttacggtatcctctaatttcttagctgcaccgaaaacagtatctttttcttcaatacaggtactaaaatatcttcctattgtagccggaagctctcttttcatctgttcgactctataagtaaaattaaatccaaagaaatcacctgcgcatcctataggtgcatgattaacaacaactgcatctcttatcatcgataattgacaaaaagcatgacctgcgttacatcccatacattgagaaaattttcttggactatctttcaattttcccgcatgagcacatgtgacaagttccttggctgatccattaaagccagtaattgaacctaaccttgtctcccttatagtcactgaagattcttttaaattaattgttcccataattacgactttcctccttaaattatttaaaataatatttttcttaaaaaataaaagaggacatacttctattaattagaagtatgtcctctagctttccagtcagacttacttaaatattattcttttccatatactcttattcatataagattgctgtgtttttatataatatattcttctcattcgtatatgtcaacatttttataaaaaattataaattattttattagaccaatattctttggtttcctaacatatactccttcacatgtaaatttttatcttattcttattttttcatttttatctacttgtataattactccatcttgtattatcaaagttatagacccataccttattttctcaaccatctttagtatttcttctagctttttattttctgtgagttctttactattaacagccacacaatcacccccaatatatacatatagataccttatatatttgtttttattatataaattatatataattcccctcaaaatttgatatataattcttttacgcctttgctttttttgaatgaatgtgagaaaaatctgcatataaaaacattttatataggagataaaaagttcttaaatgcgctccccacttttttatacgtgtatatttccctttttattctctgacactcgtaaacttttcaataaattattccctcaagtaactgttgtataaatttctaaagaataaaataaaagacccctgttataaaacagaggcagaaaatttccgcggttccactctgattattatgcttaaaatttaatcggtcttactcataacatctttatgtgctatatcaggcactactgctaagcctactaattcaagtatataaaataattgatctacaaaattaaatttaacgaccttattatttttaaacataccaaaaattcaacttagtactccaggatgcattctatagagttccatttagaattcctttcagctattttaagaattcctctctgaaaattttcctcaatatacttattcccttcatcgcattaaaattataattagtatatattataatatatactatacttttttcttattattcctattgaattactatgatttattattacctattatattctatatagtaataattagtcaatatactttttcatttttacaaaaaaatttctataacatattaagctttattatcaaagaatcccctatgattttagaacccaaaaaataaattaagctgaaagtgaagctattacattaattaatctatatataatataccgtattattttcacttagttagacagattctttataaagcaaatactctttaaacttatacttttgtcattcgaataaaatgagatatgtgggaattagtataatatgctataaaaaactatatcttcttattctttttcatggagtatatatttcaaatatacgtttttattttctaaatacataactattgaatccattaacaatcctatcatagctataacaataactattcctattacccaatcaactctgtacatattttgacatgatttaattagaaatccaaggccagaactccctcccatcatctctgcggctattagcataaataatgaataattcagacttagtttaacaccatgcataatttgcggtaaagcacctggtaataatattttacttataaaatcccatttattaagtgcaaaagattttccatgtttaatataagaatcgtctacattaagtattccagttatggtactaaaaagtattggccaaatgcatgtccatgtaataactacgatctgcgtaaattctccaacacctaaaataattataattagatgataaacaataaatggatttatctgggaacacgcatctaaaacaagttctactgatgattgcatttgttttactaaaatactaattgcaatacctaatggtactgcaattataattgaaagtaaaaatcctaaaaaagaccgataaaaacttagctctatatgatataacagtttttgctttaaaaacaattcacctattccagttataactttcgaaaaagatggaataagcacgggatctaatattttaagtctgcaaaaaaattcccaagcaaaaataaaaattactattgtaatataacctcttatattcacattttttagtttcacctaattcaactcctcccttttaatatcataataaggcacttgttaatcacactttactctttaaagaattcaataggatgttctgctttatacgctgccaactttaattgcacttctcctaaaattaatattcccgctataataatggataaaataattaaagtaaagttgtctatttttttataggttttatgatttttaaaaagtgactctggtttttcccataaaaacaacccattttgtatatatctgaaaaatctatttataataactcctaatattattataattacacagctcgcatatactttaggtgcatcaaaataatgatgtgctccgttgtgcagaagatatccaagtcctgaattgacgcccaacatttccccaacgattataataaaaaatgtcatttgaacgcttattctgatcccagcaaaaatgctatgtgcagatgcttgaatatatactttgaatattatatcaaataacgaaatattcatagctttaacgttttttattaaatccttgtcgatttgttttatcccatttaatgttcccagtaatatcggaaacacgccaacccatataattgctgcaagtcttaccatttcacctgttccaaaaaatgcaataaatacaggaattaaagaaaagggattaactttcgaaaaaattctaattaaaggttcaaacattaaataaatatcattatattttgcaaatatacttcctacagccacacctattaaaacggctgataaaagtccaaatgtaaatctccacaatgttgacattatatgcatatatagatcctcatttccccacagataacctatttctcctatagttaccgtaaaacttggaaatacatcactatttataatttttgctctagctataaattcccagattataatcaaaattatcaaacctgatatttctattagtttatctttaagctttaaaagaacatccgtattttttttcattattgtgcctcaaatttatgtgttataatatcatctactttaatagctcctttaggaatagctcctgtgttctctaagtcttcaatccatggatttatagtctgttcatcaattttcgtagtttcagaataatagtgatttccttttacttcagttcctataaattcactagttaattttgctgtttcttcaacatttgcattcgcccatttttgtgccttagtcatagctttaacaaatgctgctactttatctggatgtttttctataaaactatctgagaaatagtataaataaactccagttgcttcaccaagtcccgcttctgatgaatctgcaatttgagtaagtcctgcttcttgcgctgcatcgaaaaatggcggatgaacacctataatatcaacttgtccaagttttaaagcttcaattttttgaagatctgtttcaaatgtaatccattcaaatttatctcttgaaacacctttagcatctgaaattttattaggaatgaaatcttcacaagtattagtataaccagctgacttaagtttttcattgcctttataatttgttaagtcattccatgttttaactccagcagctactgcatctttattcacgtagaacctcatatgtctcaatttaggatctactccaggaccaggttcaattattgaacgccctactgctttaatttttgatcccccatataccttaagcgctaatgcattcggatgtgtatccgctacatcattatctcctgacaaaattgcaggtgtgacagcatcactacttagttcaccagtaaatactaatttcaatccttcctctttaaaaaatccctttttatctgctaccaaaaagggggctaatgtacaatcttttcttgttgccgtttttattggaaataaatcatcactactagtagaagtactatcatcactttttgcgctactattagcttccaaggattcagatggagatgaatatttcgtcttaccaagttgcgctcctataataatacctcctataaccaaaactgctattactgcttgaataactctttttacttttttttctttttctattgccattataatttaccctccttgaatatattaaaaagttttttctttccatacaaataatttgctctctaatatgtttaatattttatttatagttatccctaatgcagcaacaaataatgttcctccatataagttaggaagattatattgtgttttcgcaatacttataaaccatcctaatccagctgatgaactcagcatttctgctgaaataactaatataaaagctatttgcgcactaaatttaataccagtaataatatctggtaatgctgctggtaaaattactttgaaaaattccgttttaggtgatgctccaattgttcttgctgactttattagtagcttatctacaccttctacgccagctatagtgtgaaaaataattggccaaactgcaacccaaaaaattattattactttgctaaattctcctattccaaaaaacaacataaacaaagggaaaagtgcaaacggattgagtttttcgaaaaattgtaagattggaattacgtaatttcttaacttctttgaaatagaagctaagaaaaaacctattaataatcctactattaatgccacaaaaaaacctattatagctcttttaaatgtcagtaatgtatgactaagcaaatcacccttaaatatatttgtagccaattgattaaatacttttaatggttcaggaataattccagtatctaaaattccagttgaagtcgctaaataccaaattacaaagaatgctgctgttgataaagtgctaaaaatcaattttcccattttagatattactttgtttttttccttcacgttactcacctctttccttatttatacactattcttcctttaaattatcttcccaaacaattattgagctttttaaattatcagctaataccgatattaatgctcccactattgctatagtcaaaattcctacatataatttaggtacatcataatttttttgagaattagaaacaatccatcctattcctgcttcggaaccaaccatttctgtaccaataagcatagtaaatcctactgttaatgctgtctttataccagtaaatattctacttatgcttcccggaagaataacattgaaaaatatttgtattccagtagctcccattgatcttgcacctttaataaagattggatctatttgatttattcctgccattgttgtaaaaagcattggccataatataacccagaaaataatacttactttacctgcttctccaattccaaataaaattataaataatggaatcaaagtaaatggattaacctgagaaaaatttgtaaacagaggattaaagaagcttgctaacttaggaacccatcctcctaagataaatccagctggtactgctacaactgtagctaaaataaatcctattgccattctctcaatacttatagcaatatggataaatagttcgccacttaatgccatcttaaacattcttaatgctacagttgaaaatgccggtataaattgagtatctaatattccagttctagctgctaattcccatattaaaaagaaaatagctacaacaataatatttacatatctttgtttcattcttcctgtcacacctttccaaattatttaaaattataagaaatatcatcataaaaacttttatgatgttattatctttgtatctgttgctgtgactatagtataaagtctttctaggaatgttaatgcccctctataaccaacataacatctatcaataacaatttcatttgacacaggaagagcaatttccataatatatcctttcaattcttttgataaatctctatcccatgatgtaccaaaaattattggtgctctacccttgaaatcagtatttctaatgatttcatctattgtatatccatcttcagcatattcaacttcagtagatacaccttctgaaagattttcaaattgattacttatttgttttcgatatttttctggtggattatctgtaataacctgtatagctggaacaaaacctaattggtctgccaaaaatctattaagtgctaaaccataagttgaatcactaattacagcatacattgaggttacactccatccatactctgcatagaattctgaaaaactatctaaataatgataatatcttttttcttccctttttatgaagtcttcaacctttctcttgttcttacctgaaaactttgctacttttctaagaaaatctgttgtctcctttgctccaattggcacagtaggaatatgcaaaaatggttgttcatatttcttctcaagatattctgctatttcaaggccaacccatggtgaaagtacaagattaaactgcgctttaggaatgcttttccattcttctacaccattactctctaccccaaagaaaacattaaccttaaaacctgacccttccaatattcttttaatttcttctaaatctccacgccaaaatgtattttgataaggtacttctgaccataaattaataagtttatcttctttttcaccaatataatcacctacaaattgatcaattatagctttaataactatttcatgaccaattaaattatttcctttgaatccacctgtatctgcatgaactattggaaatcctaactcctgaaattcttttacaactgcgcctatgtcatctcctactaattcgcctatacacccatttagcactacgtataagtctgctttaactataagtaaagtacccttaattaactctcttaactttttttctccaccaaatacaacttctttttctgttgcattaacggatgggattaccggaccggcactatatccaccaccttgagcgccattactcattaatacaccggattgttttgatgtacatcctggcccacaatgtgtaattggcatagcatatggaattgctgatactgatgcaagtgctcctattgcacatccatagcgcacttgttctatagaatttgttctcactatctctttaacttttttactcatctatcttcttaactccttctaaatagctgctgctcttcttgattcaagtaattcattaaatttctgatctaaaaggttaggatttttagctaatacatatggatcagattgttctaaccaccagtctgtatactgcatttctgtatgttctttcagaatgttatggaatttcttttttgctaaaatatctaatatcttgtttcccagatatatcattccttgataacctattgttaaactttcatcacttaaaggtgcagctgaaattcccaattttgatgcaagtggtgataatcctccatgttttattaaaataaaatctggattaactctttttagcaagctataaaattgatactgttgtctgttgctaacactaaagtttttaacatctccataattatcaactaagtgttttaaggaatctgcttctacatttccactatcatatactggatcatgatggaatactaaagaaccatctactgatattcctagttctctaagtactgtgataagaccatgagaatatccagaaccagttgaagtgaatccttttactccttttagtttcttccttaattccttgataataggttcaactctcttatgttctttttcaatatatttttcaactaattcttccctatgagttactcttcctatttctctaagccatgcatcagttcccttaaatccatatggttgcggagcttttatttctggaactccaaaatactgttctaaacctgctgaaagataagaggataatgtataacagaagcttacggtacccgctgcttctgatagcctttccaaatcctcaacacttgctaagtcaattacaaaattaactctaagcccaagctctctaaacattggggtatatacatctgatccccaaagtgtaataatattaattaaatcttcctgctttttaggatgcttgtttactatttgtcttaagataccatgctgtgtagcgtcaaatcctgtagtccagtgctttgacttaaaaccttcgcaaatcaatggcactattggaattttaagttttttttcatattcagatgatacactttcaatatcttctccaattattccagtcgcacatgatgatactataaaaatagtctttggtttatacctcttatatgcatcttcaactgtctgttttaacttctttgttgctccaaaaaccatatcaccttcaagtaaattagtgctcataatttttacattttctattgggagatttcttgttgcaagtccaaaacggaatagtctgttattaccaacttgtccagcaccacatccaattggtgaatgttgtattaatactgcatctctaacctgacctgcttgacactctaccatttcctcagaacatccagagccttgtgcaaaaggaccttctatttcacatagtctgcagccgccatttttactaccacaacctcttccattatagtcagattgatctacaagttcagctgcattaccatcccaagctataatggttcccaatcttgtttcacgcttttcaacctctgcaatacttaaatttatttttttcatgcttctacacctttcttaatttgttattgttttaaaccatagcaataagtaattaattttgaaacagtttccctcaataattatactaagcagtaatttaataaaaaaactggaggatgtatattctatctttttaataaaatatatatcctccagttttctagtcagacacataaaattgtatattctaatctttagtctttttctatagttaatcccaaaatggtaacacatcttcaaagatactcttaagaaaattctcttcatttaaatcactattaataatacccattgatttttgaatatgtatatattcctttaaattttctttacctgttttaactgatggcatccacataaaatattttgttttagcttcttcatcctcacttacattttttatatatcctttttccacagcattacttaaagatttatccttaccttcctcaacatcagccgcgccttcaatccacgcgcgtaaaatgcctgctgtcttttctggatacttgtcagcaatctcacttcttactccagcaaagttaatataaaaataactattgccatgattaccatgattattgcctgatgacttttcactatctataagtccagttttatatacaacattaatattattatcttctctatttatatcccaaaccacggcagcatcaacctctccattttcaatagctgttgttggattttcatcctttaaataaacccatttgatactattatcatttatattatttttatttaatacattaatggcagcggccatagttccatctccttgatttgcaatacctattcttttattttctatatcggtaattttttgaagattactatcttttgatgttataatttcaattgcaccgcttgtaatccccatactaactttcatattaatattaggattattccattttaaaaatttataatcgcatgtaaatgcatcaatatttccattctttattttttcttcaacctcattatcattaatttttactaattctacctttactccttctttatcaaaatatccattttcatatgccgcaaataaaggcaattcagtaaaatttccgatatatcctatttttactacatcatcattttcatatgattttgagcatcctgtaaacatcagtgctaatatcacaatagttaatataaaaaatttattcttcattaaaatctacctctttaattgctttgtgaaactaaacttaagctgcttcattatcacttgctttaaaaacaaattaacaacattggaattatacatacacactaggactatttctataatctcttacatcttatgtgtctcatcttttaatccattaaaaactggtgaaaattttagttaaatagctcctattatgattttgcacactaaataacaactttataatgctattgcaggagttatttcctttgaaatgatcaattcatcatcatacgtctcttttttctcttctgttttattatgaagatattcatatatcttattagttatcctgttataatccgctgaagctctcatatcagaatttgttcttggtcttggtagatttatactaactatttcttttatagttccaggatttctagtcattactacaactctatctgcaagcagaacagcttcttcaatactatgagtaacaaaaattatagttttattcgttttgccccaaattctcataagctcatcttgaagattttctctagtctgagcatcaactgcagcaaatggttcatccataagcaacacctctggatcatatgcaagggaacgcgctatagcaaccctttgtttcatacctcctgataattcatgaggatacctgttttcaaagcctttaagtcctataagctcaatgaattcatcacttattttatttctttcttttttaggaactttctttaattcaagaccaaactcaacattttttcttattgttctccatggaaataatgcatacccttgcattacgaatcccctgtctaacgctggtccattaacaacttttccgtcaatagaaatacttcctgattctgcttttactaaacctgatattatatcaagaagtgttgattttccgcacccacttggaccaacaattgcaataaattctcctttaccaattgataacgaaaaatcttttaacgcttgaaatttttctttttttgaattttcctttacataatatacttgacttaagttatttaatacaatttttgattctttgctttctacattatttactgtcataatattttcctccaaattcattatattgttcttaaaatcattaagataagtagcgttaatactatttgctataatgctattattttacttaaaattacgtgattcaaatatcaagaaaggcattaaataaaattatattaatcctatttaatgcctctagctttctagtcagcttaatctaaaatatttgaacctagttaatatagccttttagtttaatcttcaaaggcttgtgataaatcataaattatatcatcaatatgctctgttcctattgaaagacgtattgtatttggtttgattccctgatcaagtaattcttctacacttagttgtgagtgtgttgtactagctggatgtattactaaggatttaacatccgctacatttgctagtaatgaaaagatctctagtttatcaatgaaatcttgagcttctttagcatcacctttaatttcaaatgtgaatattgaacctgcaccattcggaaaatatttattatataattcattatctgcattttccggtaatgatggatgattaactttttcaaccttaggatgcttattcaaaaactctattacttttaacgtgttttcaacatgtcgttcaactctaagcgaaagagtttctagcccttgcagtaatataaatgcattaaatggacttatacttgcaccagtatctcttaataaaatagtacgaactctagttatatatgccgctggcccagccgcttctataaatttaataccatgataactcggatctgcttctgttaattgcggaaactttccggaacctaaccaatcaaattttccagagtctacgattactcctcctaaagttgtaccatgtccacctataaactttgttgctgaatgaacaactatatctgcgccatgctctattggtctaaatagatatggagttccaaatgtattatcaacaattagtggaattttgtgtttatgtgcaattgctgaaagtccatcaacatctataatatttgaatttggatttccaagtgattctataaaaattgcctttgtattatcttgaattgcattttcaaaatttgataaatcctctgggtctacaaatgttgttgtaataccataagtaggtaatgtatttgctaataaattataagatcctccatatatagtttttgcagaaactatatgatctcctgcacgagttatattttcaatagaataagtaattgccgctgctcctgatgctactgcaagaccagcaattcctccttctaaggctgcaactcggctttcaaaaacatcttgtgtagaatttgttacacgtccatatatgttgccagcatcagacaatccaaatctagctgcagcatgttcagaatttctaaacacatatgaagttgtttgataaattgggactgctcttgcatctgttgcagaatccggtttttcttgtcctacatgtatttgtaatgtttcaaattttaattttctttcttgattactcataatttttcctccattttatttaattattttttgtaattaatatcttctctaagtttcttgataaatgtttctactttcgacaattgcttagctatgcttattattattgagtaaaattaaaaggagactaatttatcttctataagtttagaaaataaatttagtctccagttttctggttaacttccactaagaaaaaaatctttaagtattccgatagtttttataagaaatgtatttttattatagtataacatttagataattttgtcaatgaacaatttatatttattaatttaaatattttgactctaaaattatttcaatgcaatgattacatatcatttaattaacattagaatctatcttatctactacacttattttgctttttatcattcccattccacacgtatatggtatttctcttatttctttaggcgtaaattcaatgatattctctccttctttcaaatgcttatcaatatttaattctgaaataacaatctcgttattacactcatttaatctatctttttccacttctataatccattttactggcacatctttttgaacacgtatctctggaaatgaatctttctcaagttctgtaattaaattttgactacctccattaatgtatgatgtataaaccttacttgaatcttttgattccattttcatatccatcgcattagctccaaataatgcaaaacctctatttattagtgaaaatcctaatataaagactagtattgctcccactttagctattttaacagtatatcttctgtttaaccgagaatttatagttccaaatatcatcaaaactggaagcgtgcctataccaaatagaaacatagaaaaacttccaactataatacttttacttcctagtgcatataattctactgtttgaagcggtacacatggcattattccactaattagacctaagaatattggtccatagtttcttccaactccaatttttcttataatttttaaagaaggattccaattgaactttcttaaaaattttaaaaatcccaattgatttatagcggtaataattataaatattcctcctattattggaacaatccctttaagtatttcagtaaatccaagaacactcccaattccaccagcaagtccaccaacaatagtatatgaaattattcttgaagcattatataataaatatccgttaaattttttcttattttctactttactccctaatacttgagaaattgtaaaacctccgcacataatgatacaatgaaaagaacttagtaatccgaagataaatattataccataacttgtgtttgtattaagatccggcagatatttaagcaatattatgttttgaaaaaaatttattatttcatttccccattcattcatcaaaagctcctcctttctctaaaaaatggctttttgctacttagtcccctttttaaacttaatgaatttaaaagtacggataaagaactagctgacattgtaattgcagcaatggctggtgttaaatgccctgtagctgcaaacggaattgctattatattatagataaatgcaaaaattaaattttctcggatttttcttcttatctttttagccttcttaatcgcacttggtatagacagtagattactattcaaaataattacatctcctatttctattgccacatccgttccacttcccatagcaaaattcacatctgcttttgacaacgcaaccgcatcattgattccatctcctaccattgcaacagttcttccatcagcttttaacctatcaattacttttcctttttcttctggcagtacttctgcgataacactagtaatccctactttatcaccgatttctttagtggattttttattatcaccacttaacagtattacatctataccattattttttagcttcgcaatagcctccttagcatcttgctttatagtatcagataagaaaataattgcttcacagttattatttatgcctataacaataactgtctttccattttcataacctttattttcaattaaattacttagcgcattatctaagcaaataccttgctcctttataaatttttctgttccaatgattatttcattgttattatagatagcaattattcctctccctggaatagctttaaaatcatctggatcttctatttttgctgaaaaatctttctcaatttcttcatatatagctttacctattaaatgttctgattttttttcagcaattgcagcaagttttagaattttttctttttctaaattactcttatcttttacaaatataatctcatctacagttagatttcccgtagtaattgttcctgttttatcaaatacaactgtatctaaggtacataatttttctattctggcactattttttattaatattccttctttagcgagatttccaattccagtcataatagcagtcggcgtggcaagtcctagtgcacacggacaagatacaactaaaacagctacagagtatattattatttttgataaaaagtaagaactcccatttaagataatgaaataccaaataatgaatgtaactattgaaattaaaacaaccacaggaacaaaaatgctgcatactttgtccactaaattttggattggagccctgctgttttgagcttcttctactagttttagtatttcaccaaattttgtttcacttccaactttagttgctttaaacttaaatgtgccatacatattcaaggtagctcctattacttcatctccgatgcttttttctacaatgaaactttctcctgtaatcattgcttcatttactgatgaatttccttctaatataatgccatctacgggtattttttctcccggtcttactataattttatcttctggcttaacttcttctattggagtatctttttctactccattcatttcaactctagctgttttagcttgtagattaagtaaagattttatctcctttgaagtccttcctttcgttatttcctctaaatattttccaagtaaaacaaatgttattacaaccatagaagattcataaaatacattttttatccctgatgagttggttactccaaagaatgatgtatataaactataaaaataagttacggttgttcctaataccacaagtacatccatatttaaaattttagctttcacagcaaaataagcttttttataaaatctagaacctactataaactgaactggagttgccaatataaactgtaatctccaatcatgaaggaatagagttttatatcttaagctttctaaaaatttacttaagcttgatttgtttaaaatgtcaaaagatatacaacagtcactagctccattaaggatcatcattaaaatcataggactggttaaaacaaatgatattattactaattttcttaatgtgtcgatttcactttttctcttattaggcacatgattttcttctagatcgtataaataatatccacttttcttaagtttgtcttttatcattgaaatagaaattattttactatcatattcaatattaaccttctcgcttgcataactggcttgaatatttactactccatttaatgttttaattgcattttctattattattgtacaaagtgtacacgtcattccttctacttttaaagtagttttttcaatcaaaagcatcacctctataaaactataaataatattctaaatctttaggtttacttaccagatttaatttttcaagtattctcttacgtagcttcaaaaaatcatcactggtacgatttcttggtcttcttaaattaacatcaattacctcttcaatttttccaggccttggagacattattacaatccgattacttaaatatacagcttcatcaacatcatgagtaactaaaatcattgtgttttctctttctttccataattctagcagcttgtcctgaagcgcaaatcttgtaaaggagtctagcgctcctaaaggttcatctaataataaaaccttaggactgtttataagcgctctaactaaagatgctctttgtgccatgcctccagatatttgatgaggataagatttttcaaatcctttaagtcctgcaatttctatataatgtgatacctcttctttgtgctctttatatatttttcttgctctaaggcctgctgagacattatcctcaatattttgccaaggaaacagattagcctgttgaaaaacatatcctctttcataactagttccattaattttttcaccatctaaaaataattcgccttcttgtgcttcatctaaacctgcaataagtctcataagtgttgttttgccacatcctgaaggccctataaaagatataaattctccagattcaatattaagatttatatttttcaacgcttcaacttcattaccatttgcatcaatataagttctgaagacattctttacagtaattgaaccatagttcctgctattttcttctatcattttaacaaccccttttgccatactaataccttatctctaattttgaatataatagccattactattgaaaaaacaattgccattattattatagaagcataaactttagcataattagaccaccctttagcccaattaatataccatccaaggcctgccttagctccaatcatttctgatactactaaagttgcaaatgaaagcccggttgccgtatagataccaataaaaattgaaggcattgccccaagaattgctacattaaaaatcaaaaaatcatccttagctcctaatgtctttgcagcttcgaaataagactttggtaaattttcaattcctgaagacgtcataaatgcaacaggaaaccatacacaaattactattaaaaatatttgggcataaaaacttgaagggaatataaacattactataggaatccatgctgtagctggaactaccccaataatttttattattggaaatatccaataatgccactgcctgtaccagcctattaatactccagtagttattcctaaaattgttcctattgtaaatcctataactaacagcctcattgaatgtccggtacttattattaaagttccataatcttcgaccataacttgaagtatttgagcaaagcttggaaagaatggaagtggtaaagtattagattttgttgttagtaagtcccacattataagcaatatacctattcccgaatacagttgcgcattatgattaatcttagctttaatcttagaattaaataatgcgattatatttgttactataaaatacgctattaaaattattagaaaaaatctgtaaggttctaaaattacattttgctttaatggaattacaaaacttacaagaagcgctaaagcaaaaattgcaatattaataattctccatactacagattttggcttccaataaagagcatctaacaatttcaatccaatatcttctttatttctttttaatataataatatttgatacattttttgccttctcaatatttacttcttgtaaatccatgtgcacaactcctatctttttaactctttaaaatatcataataagtatcattggcaaattgggctggatctgtattatcctttaaaaatcctgttttatctaattttttaacaaaataactaatatcgtcttttgcagtatctgttgtgtattcaaaatcgtaagacttaataagctgtgttacaagcttaacatcatcagatgctatatattttttatctatttcaagttgtgctgtttcttctggatgttcttttatccatgcatcagccttttgatatgctctagctatagctttaactttatccggattttcttttatttgattttcgcttgcatatagaaaacagcagctcttacctttaaacaatgggtctgttgaaatatcagttaatacagtatatccattgttttctacagctaatgttccaaatggatcccatgctgcaaatgcatcaacttctcctttactaacagcttcatttaattgatctaaaggatatggtttccatgttacttcggtttgaggattaattccagcattagctaatacaattgttgctactgacattggcgtaccaccaatttcatcaacccctatattcttaccttttaaatcagcagcagtcttaattggtgaatttggtggaagtactatttttatacatcctttgtgtagccctccaatcacttttaagttcattccttgttgtatagatggaaaccattgaaagtcaccattagttacaacaaactctccagttgcaagcccagttttattttcatctaaggttccactaacaagttctacatccaagccttcttctttaaaaaatcccttttcatatgcaacatacgctggtgccccgcaaacagctccactaagtgcttgtatttttaattttccatatttatattctgaattgactgcttgatctacattcttttgacatccagtaacaaaagcactgatagcacaaactaatgtcagagataataatcttttgaatttccccattactctttctccccctatctataaaaattttaattaatttctttaaatatttattgcaaactcagaccttaggtttcatataagtgatttccataacttatatgaaatcctaagatctttttttagtatgctttgatgcatataatttttacggaatatctaggcatattatcacctccttaaagtacttaattttaaatatagacttaaataaaaatctaaatagcataaatattattcctttatctataaggtgcattattaaaagaaaagggcatatttccatagctatagaaacatgtcctccggttttccagtcagataactaaatctaattaatttttatgctttatattcttctcatttattcaagtatgtagctattaaatatctttgtaatgcaaaaagaggacatattcaaattaatgaaaatgccctctggttttccagtcagataatcttttatttcttacaattcctatatatttagtaaagtatattaaatatatatcacattgaataatttgtcaatatatatttacaattttattagtatttattagatactttaatttatttttttagtaaatttctcataaaaaaaaagctacctaagtaaagtagcttatagttattattttattaaatttaataaaactgtattaattgcaaacaatgccataaaaacaactgttaatctcacaagaattacttctttagttctcgatttattttttgcaaagaatgtatcttttgtgcttccttgtattaaaccacttaacgcatcagctttactaggttgcatataaacagttataatagtagctaagcctaatattccttcaaaaattaataatatattttgcataggtaacacctcctataatgatcaataacatacatttaataatatcacatttatttacttattacaacttatgtaataaaaattacatcaagatcgaattatttagaatttagaaaaaagttataagaactatattcctataacttttcctaataaactttattgtgatttatccttaagcaaaattacttctgccttaaaaattatctttaataataatttattttatattaaagaaagcttttctgcctctgtactcagcaacatcatttaactcttcttcaattcttaacaattgattatacttagcaactctttctgatctagctggtgctccagtctttatttgacctgcatttacagctacaactaagtcagctatagttgtatcttctgtttctcctgatctatgagaaacaactgctgtatatccagctctatttgccatttctatagcatttaatgtctctgttaatgtacctatttgatttagcttaataagaattgaattagctacaccaagatcaatacctttttcaagtctttctgtattagtaacaaataaatcatcaccaactaattgaactttctttcctaatctttcagttataagcttccaaccttcccaatcttcttctgccataccatcttcaattgagataattggatatttattaacccaatcttcaaagaaatcaaccatctctgctgatgttaatgttcttccttcatgttctaatacgtatttaccatctttataatattctgatgaagcagcatcaattgctataaagatttcttctccagccttatatccagcttttcctattgcttcaattattacatcaagagcttcttgatttgattttaagtttggtgcaaatccaccttcatcgccaatacctgttgaataacctttatcatttaaaattttctttaatgtgtgataaacttcagcacacattcttaacgcttcactaaatgtaggtgctcctgctggcatgatcataaattcttgcaaatctacagagttatcagcatgtgatccaccatttaatatgttcatcataggaactggcaatacttttgaattaactccaccgatatatctatataaaggcatatctaatgaatttgcagctgcatttgcaacagctaatgaaactcctaatatagcattagcaccaagcttactcttattgtttgttccatctaattcaattagcattttatcaatgtaagtttgttcaaacacattgcatccaattaattcttctgcaataatttcatttacatttctaattgcatttaaaacaccttttcctaaaaatttatctttatcaccatctcttaattctactgcctcatacattcctgttgaagctcctgatggaactgctgctcttccaattgttccatcttctaaatatatttctacctctactgttgggaaacatcttgagtctaaaatttgtcttgcaactacatctacaatttctaaataatctttcatttaatattacctcctcatttttataattgtattgagaattcttatcaatataattataatacataatttactaaataaaaagctttttatttcatttaccataatattattggtaaaataatttaggaatattcatattattttttatgtaaatataaaactgacttatatggtttaattagatcaaaagtcaaacttacataacataatttatttgtttaatttatacaattcttcttaacatattagccgatataatcttttatataaattccattagagatttactcaaaatgatactaatgccataaaatttataagtgttttacttaaaactcattacattaaatattcattttgagttatcttctcctatatctttatatatttaatcatcatctaatatcgataaattttttgccccacaatatcttctaaattttaattcccatgatgcagctttctttgcgtctattttctttatacattcaaaaaattcatccaatacaccaactttgcataatcccttcattaagtgtcttggataatcaacctttctactgtacgcctttttaggatctattatcataagtttttcatcctctgagacataaacatctttacatctgatatctaattttttaaatttaagtctcttgaattctaataataattcatatatgtttctaactaatctttcacttaacccattctcctttatatgcttatcaagccttattccatccacaagatcccttatcacatagaattttcctctcttatacatatagggaaagtatttcgacccattagttttagcaagaatactgccctcatcattacatacctttttcctcagaaatattttgatagcttttttatttggcaactcataaaccacaccattgtttccctcacctagatacttagcctctctaaataatttttctgtatactcatcaaaatcagcagaatatgcaaaattctttttcatattatcaatcctaaatcttttttactaatatattaattttatgcttattttatgcaattctgagtaaatccttctttaaaatcttatttttcttcccttatttaagtagatttgtacttagtcatatatatgtttaaatccacaattactgataaaattcttgcaatattttcagaattatcataaagaattatttttgcaatatatataataagttttaattaattaagcttataatttagtgtatataacattggctttttttaatgacaactaaaattttaataaagaaatttcaaaaaattatattttttctaaaataaaaaactgcctgaaacaatttaaaaattatttcaagcagcttttttattaattaaaattacttatttactattagattttctccagtcatttctgtaggaacttcaagtcctaattgaactaacattgttggagcaatatcagcaagttttccgttgcttaatttcttaccttcagtatcatttgcaacccaaacaaatggtacttcatgtgtagtatgcgctgtatatgggtttcctgttgaaaaatctatcatagtttcagcattaccatgatccgcagtgataaataaacatccattcttttccaaaattttatctgcaatctttcctacacattcatcaactgtttcgattgctttaactgcagcctcaacaactcctgtgtgacctaccatatctggattagcaaagtttagaattaccatgtcgtatttatcactatctaatctatttagtaattcatctgttacttcatatgcactcatttctggtttcaaatcataagttgcaacctttggtgaaggtataacttttctgtcttcacctggattttctttctctactccaccattaaagaagaaagtaacgtgagcatatttctcagtttctgctattcttaattgatttaagcccttattacttacatattctccaagagtattacttaaagtttgaggagtatatgcaacatttactctttctagagtcttatcatattgagtcattgttacaaaagtaagatctaaagtttctctcttgaatcctgcaaattctttatcattaatagctctagttatttctcttgctctatctggtctaaagttaaagaatataactgaatctccatttttaatatttgcagttggattaccattttcagttacaactgttggtaatacaaattcatcagttttattatcatgatatgatttttctatagcttgagttgcactacttgcagtttcaccttttcctaaaactaaagcattatatgcaagttcaactctttcccatctattatctctatccattgcatagtatctaccacttacagttgcaatcttacctacccctacttcagccatcatcttttcagttttttcaatgaattcttgtcctgatgaaggtggcacatctcttccatccataaatgcatgaacataaacattttgaacttcttctttcttagcaaattctaaaagacctcttaaatgttctatatgtgaatgaactccaccatctgataataagcccattaaatgtaaagacgatcctgtctttttagcattagtcatagctaattttaatgattcgttctcaaaaaaatctccatctgctattgcttttgtaattcttgttaattcttggtatactattctaccagatccgatatttaagtgaccaacttctgaattacccatttgaccttctggtaatccaacagctaagccactagcttgtaattgtgaagttgggtatttttcgaatagtttatctaaatttggctttttcgctaaagttacagcatttccttctgattttggtgcaatcccaaaaccatctaatatcattaacataacaggtttttttgacatttcctatccctccaaatattttcacaaaatatactataaaattcttagatttctttattaaattaatatctgtaagttaactaaataaatttatttgttagaaatatataatattaaatattatcatttattatgttttacatactattaatatcttaaattatattatttttttacacttaatgcaactttataaacatttaaagtaaatttatgttattataatataaatgttttatgaattactttaatatcaaattattatttacttaaaaaaagctgtcttagtgcgattttcgtcattctaagacagcttaaaaaatttaatactaataattaactattgcagcgaaatcagctggaactaagctagctccaccaactaatgctccgtctatatcagacatttccatttgtgcttttattgtatttggtttaactgatccaccgtattgaattcttgttttttcagccgattctgatccatacatttcagcaaccatagctcttatagccttgattgtttcatttgcttgttcatcagtagcagtttttcctgttccaattgcccagattggttcgtaagcaataacaagtttttctacttgttcattagttaatccagctatatcagcttttatttgagcttcaataactttattagtagttccgttttctctttgttctaaagattctccacaacaaagtattggagtaatattatgttcgaaagctttcttaacttttttgtttaatgcttcatcagtttcattgaagtattctcttctttcactatgacctaaaacaacataatctattcccatagcttcaagcattcctggagcaacttctcctgtgaaagctccactttcttcaaaatgcatgttttgtgcagcaacctttatatttgaaccagctacagcctttttaacagcatctaaacatacaaatgtaggacatacaactacatcacatgtagcatctttaactaatggctttaattcttctaccattttaactgcttcatcaatagttttattcattttccagtttcctgcgataattgcttttctcattccactcacctcataatttttttattaatgaaacttataagtcttaattatattatgaatctatataagcttaaggaaagtgatcaaatttccttaagcttattatatatctacaaaaattacaaactaaatatttaagaatggctccttggccttggacccaccaaatcccgtcgaatttgcttcctaaaaaaatagcttattactttttttgaatatatattccctaactattcaaatatcttacttaaccatctagcatcttcaaaaatctattacttaaatataagagatatgtttacactcttgtggataagttcaacttaaattcattagggggcaatcactacctataaagtttcactttataatctaactaaacttataaacttcttttgaaaatattatttattcaaaaccaattatttaaaattagtcgtttaatgcagcgattcctggtaatactttaccttctaagaattctaatgatgctccaccacctgttgaaatgtgagtcatcttatccccaaatcctaaaatattaacagcagcagctgaatctccaccaccaattatagtagtagcatctgcatcagccatagccttagctactgcaattgttcctttattatagttttcgaattcaaatacacccattggtccattccaaattacagtcttagcatctttaattgcatcagcatataaagtttctgtctttggtccaatatccaatcccatgtttcctactggaatattttgatcttcagtaattgtagcttctacatctttaaattctgcagcaactctgtgatctactggtaataagaatttaactcctttttcagcagccttagcaaccatttctttagcatattcaagtctatcttcttcaactaatgaagttccgatttcatatccttgagcttttaagaatgtataagccattcctccaccgataataattgtgttaactttatctaaaagattgtttataacagcgattttatcagaaactttagctccacctaagatagcaacgaatggtcttactggactttcaactgcatttcctaagaattttaattctttttggattaagtatccacatacagctgtatctaagtaatcagttacaccaacagttgaacagtgagctctatgagctgttccaaatgcgtcattaacaaatacatcagctaatgaagctaattctttagagaattctggaatgttcttagtttcttcttttctgcatcttgtgttttctaataaaacgatgtctccatctttcatttctgaaactgcttttttagcgttttcgccaacaacttcttcatccctagcaaaaacaacttctttccctagcatttcgcttaatcttgtagctactggtgctaatgattttgaagcatcttttcctaaatgtgaacaaagaataacctttgcacctttttctactaaatatttaatagttggaagagctcctaccaatctattttcatcagttataactccatctttaagtggtacgttaaagtcacatcttactagtactttttttccactcacttcaatatcttcaattgttttcttattgaaattcatttattttcacctctgatatttattttattgattattccttcattttaaaatagtctggctttatagccttatactacaaaaccagacttatttactttaacataaatttgcgctctttatgttctaagatataattcaaattactttaagttagcgaagtatcctaaagttctgattaattggttagtgtatgacatttcgttatcgtaccaagcagctactttaactaattgttctccattaacttccataactttagtttgagtaccatcgaataatgaaccgaagctgcttccgattatatcgcaagaaactatttcatcttcagtgtatccgaaagattcagttgcagcagctttcatagcagcgttaacttcatctacagtaactttcttagataaagtacaaactaattcagttaatgaaccagtgattgttggaactctttgagcaccaccatctaattttccagctaattctggaataactaatccgattgctttagcagcaccagttgagttaggaatgatagaagctgcagcagctctagctcttcttaaatcaccttttctgtgtggagcatctaaagtattttgatcgttagtgtatgagtgaattgtagtcatgaaaccttttgttaatccaaaatcatcacttaatactttagccattggagctaaacagttagtagtacatgaagcacctgaaataactgtatcttctgcctttaagatgtcgtggtttacattgtaaactactgttggtagatcatttcctgcaggagctgaaataacaactttcttagcaccagctgcgatatgagctgaagctgatttctttgatgcaaagaatccagtacattctaaaacgatatctacgtttaattctccccatggtaagttttcaggcttagcatcagcagtaaccttaatttcttttccattaactacgaaagctccttctttaacttcgatttctccatcgaatcttccttgagctgaatcatatttaaataaatgagctaacattttagcatctgttaagtcgttgattgcaaccacattaaattcagggttgttaatcattaatcttaaagctaatcttcctattcttccaaaaccattaattgctacgtttaccattacaattacctcctaataatgcttttcttttttataaaaataaattttacaaactaatttaataactgaatttaactatttagtttacttaatattcctttggctgctgcctcatctgtaactaaaacaccatcattgtcgttatattcagttgcaataattgactctactttatttttcccacctgctactgcaatatgtgtttttatttttcttgcttcattaattttaattccaattgcggtagtttctgagattattttcgaatctttattaaaataacatccaaatgcttctccaacagctccattattaatcaaattatcaatttcttgctgtggtacacctctttttcgagccatttgcaccgcgttacctataccataaattagtacatctgccttatgtatagtatctataacaacttttactgcctcttctttaagcaaggtgcctattatatctagactcaaattttctgagatgtgaagcatcttataagtaccatttaatttttttgccaaagtggctgctaacgtattggcctgggtttcaacctttttccccattccacctctagctggtactacttgtatctgagataaatttgttactcttggaaaagcttctacaacttcttttaaagtgctcccgcctgttaatgctataatagaattatcttttagcacatctttaacataattagcacacgcttttcctaaatcctttaaaactaaaggattttcttctacatctcctgggactatgattactttttttaagttaagagaagattgtattttcttttcaacttctgaaagaccttttatttcatgaatgaaatcatttagtttgtgtataatctctacgccttcacttgtaactgtcattccagaagtatttatctcaattaaaccttgttcttttaaaaaacctatttctgttctaactgttctttcaccaacatttaacatatcagcgagtactcttcgtcctataggttgattatgaaagattgttctgagtacgttataccttttctccaatgtatttacaagctcaggaactatcttcttttgtaattctaatatttcctgcaactcaaacactcctttggtcactacgtgtcccatatcatttcattacgtcccacatctattattataaaacacctttttgaaattttaaagtctttaggaaaactttttttataatatttcaaaaaaaacaaaaaaaccctaacaaaataaattattagcaaacttttttctagttttatacagcgttccatatttaatattattacgcttaataatagctatgtgaaatagtatttttgaattcaagaaccattttatcaactgtcaatattaattacagaaaaagtaatcatgaactttatatattactatactcaaagttaacatattcttaaaacgtaattgaatattgacaattgaatttttaacattaaaattttaaagtaattattttatggaatttttataatctcttccttgcagaagatgatttaatacctaattcctctctatattttgcgacagttcttctagatatattcatatttttttctactaacatagaacttattagttgatctgacaaaggcttacttttattctcttcttctattattttctttatttcattttttatttttgaagttgccatatcttcattattatttgaggataacccacttgcgaataaatcttttattttaactgttccataacttgttaaaacatatttatctttaattgctctacttacagtagattcatgaagattgattatttctgcaacttcttttaatgtcaaaggttttatatactgtcttccaaacttaaagaaatcattttgcttttcaacaacacattctaacaccttatatagtgtatttttcctttgctctattgacttaattaagaaaagtgcttgattaattttttccttaacgtaagtgtttgtttctgaatcttgattatttcttaaaacatctctatatgttttatttatcataagtcttggcaaaacactttcattcatcaaaatgaaaaattcaccatcaacattctttatttcagcatcaggaattatataattaacctcttctcctgtataaaatcctcttgatggtttaggttccagcttctttattaaatcaccatatctttgagcttctcttggatttatattaaggtcctttgccacagtttcatatttattttccgcaatattttctaaatgatttaaaattatcttttctattacatcatctaaaatatttaattttaagctctggataagcagacattccttgatattcctagcacctattccatatggttccaacgcctgtaccacttctaatgccttattaactatctcttcaggtatattcaattcttctgcaagttctcctgttgatatttccaaatagcctctataatccaatgattcaacaatataattacatatatctaacatatattgatctatgtcggcttcaatcaactgctcttgtaaatattcttttagtgatacttttttctcaatgaaatttaatggcgaaacttcttcattagaataatttatttctgatctatccttgtaattatcagaatataattcttcaactaattttttatgatcgtatttgtcttctatattaacgtctctgtttatctgttcatcatcatatgagcttatttcctcattaacctctaacactggattttccgaatattcattgtcaatatattctctcaaatcatgaagagacatttgtaaaagctttatggattgttgcatattttgagtgagtactaatctctgttcctgggtcatcttcatgttataatccaaattcataagtttcctccttataatttatataaattatttttaattaaacgtattcattaaatttattgaagtaatctctctttctattagtatacctcctattctgtaaatattgcaagtccactatatgtaactatgaaaattaggtctggtaaaataaatataaaaacatgcttatatactacttatatcaactatgtttaaatataaattgtagctaaaagcatgttttttatttattaattaaatttatttatttaaaaaaactaatccacagcagccaggtccagaatgtatacatacagttgatccaactggacattcaataaagttaacaccattgtccttcatatatgttctaagtgcttcctttacttcaatattatttacgtcaatcaatattacaggtacttcataatctaacgtcgcgttttctaaatcactaataattttcttaatcgcctttttatttcctctaattttatctttaactgacattataccatcttttatttcaagtattaattttattccaagcattccaccaaccatgccagcagtttttgaaattcttccgcctctcacgaggtattctaaagaatcaaagtaaactgaaagcttaactttatttctaatgctatttaatttttcttctacttctgaaatattataaccattttctctgagcttaacagcttttaatacaagtattcctaaagcggctgttacattctgagaatcaacaactattatatcttggctttctagcatttccttagcaatacatgccgattggtatgttccactcatcacagaagacatatgaattgatataattttatatccttccgctaagtacttcttatatatttcaacaaatctattcggagtaacttgagctgtagttggaagtatattttcatttctaattctttcaaaaacttcatccgtatttatctcaacgccatctagataactttcttcaccaaagtttatcaataatggcaaaacttctatatcgtatttctcatatatatcttttggcagatcagcagtgctatctgttataatttttatcttttccatatatcttcattcctcttcaattatttcatattaggaaatcctatctgccttaaagcttcataagccactatggctactgtattagataaatttaaacttctagtacttgattttatcattggaaccctaaatccaatatgcctattatgcacttcttcaggaactccactagattctcttccaaacattataaaatccccttctttgaaggaaatttcatcaaaatgcgtttctccatgtgtagtggataaatatattgttttctcaccatattttttcaaaaattcttcatagctatcatgtatttctagatctaaatctttccaataatctaaacctgctcttctcacttgcttttcatttatttcgaacccaagaggttttattaaatgcaacttgctgcctgttaaaacgcaagttcttgcaatatttccagtattctgaggtatctcaggttcatataatactatatttaaattcaaaacgtcaccttctcctattttgtacaaaaattatttcactttaatttaaaattatactatatggttcataacaagtcaaaaataataattgcttaaccatggaaaagtctttcactataaaaggtatattattgtgtattctaatcagtaaattattaaatatattaaagttgttttaaccttaataaaacttaagcatattttctctaattaatcttaataattcctaaagaaaatatgctttgagttttttataaatattaaattttgacctattgtgttggttgagctacaggtggttctcctgttggctgagctgctggcggctctgctgttgtttctggctgttgagtcgcatctacaggttgagttccttttttgactactattcctacacttgcataagtatctgttgatactacttctctattcacttcagaaccattttcataagttatctgatatgctcttgctctataaccagtcattccagctccctctgttacttcttgtcctactggtaaactgctatcatctaccacttttgtttctggtggtattgtttcaagaatttcacttgccatatcatatgttcttccatttaaagcactaggatctccatatatactgtaagtcactactttacctgacgtattcccttgaatatatataggaaaatcatatgtgtttttaaacttataatctaaatatccatatgaaacagtggcatcaagcccaggttgtgcataaccaacagccatggaatgatttgttctttcaatagaccttaggtttgctttcatagcagctctataaatagtggtcgatacttgacatattccaccaccaattccgggctctattttatttccaacatatgttccagcttccttataacctctttcagctgttctaggtccaacaacgtcattaaaactaaatatttctcctggcataactattgttccgtttattgctgaagtagctatttctatgttattacatcttccttccggcgatgtggaataatttgatgaaaaagtacccattactccttttatcttggatagatcttcttgagttattttaggttttgttacttctaaatcaattgatactgaattatcagaattaatatctccatttatattttcttttaacttctgatctagtgtatctaaattaactgtctttccttctgtttctggtttaatcacaatattattcttttgtatgctaactgctgcatctttagcaggttgattaacagctatctgaagtttttcctcgtattccttcaatttttcttcattataagaaaatttgattggaacctccttgctcttactattattactctttatgcttatatatctgcttaagaccccatctttttttccaagtttataagcctcttcaacagttgcatctatatcatatttaggattaatatcagagtaaataagttcatattgtttgtcctctattttaatagataactttttattttctatagatgttacaaatgtttgggtaagcttattcttggcttcttctttagtcattcctccaatatttacttcttgtacagttactcccggatatattttatcatcccactccttaactataccttttatagctattgagtatgcaattagtgcagcagctcctactataattaatgtaaatattgcgagcataattttcttctttttattataattgtttttagaagcgtttgctcttttgccggtgcgtttttccactcccttattctcctttcaaggaattaaatatcatacatcttatatgtttaatatttattttgagtacatttatcgatgacaatttacatatttttcaaattgtcatcaatgttttcattatatcatattccaactatcaatagaaatatgattatattcccatataagctgaaatacgatactatttattatagatttacttttgcacgagtttttgaagtttctccatcataatcaaaagcttcaattgatacttctactggtgcattcttctgagtatttaccttattactagttattaagtaacttgtagcattttcatcaacagttccaacccattctctatttacaaaaatgttatatcccaataaatctacatcaggatttctattccaagaaacatttatgttcctattctggtacgctgcctttaatccagtaacaacacgaggctgccttaataaatctacattatccggtccccaatttgcatcaacaggattcccaattccttgtacagtttggctttcactatattgccatatcctccatctggtccagcctccaacattaggagggaattcaggattaatagggatgcttgtatacattgcaatccatagtggcatattttttagtggatagccacgtccaggaatataaaaattatcataaagctctataaaatttgttcctgtgtaaatcataagccttcttctagtttttctttcaaatctttttctaaatctatcaatccaatcaattaatgttcttgtacttattgatttatccaaaggtgcctctacatctattacaggaaacaaatccccataatcattgtttccgaacccctgctgcagtgtatttataaagtcatcacattgtctatccgcatctgttagatcataagatggcatagaaaaatgatatgctccaactgggattccataattcctactattcttcgcataatctacaaactttctatcaaccctaaaccttcctgttgcagatcctgacgctctcaagtacaaaaaatctacttttgttgccaatacgttaaactgaacacttgttgtatattcatttatgtctactccaaaacgactgttaggatttttgttttgcatatttcctccacataaaaatacttctctaatataaatattaatttacaacagaaaaagtacctataatttagtaattaattataggtttagttgtacataaaaacttatattatttcctactgattcagcccatattttgccgtcatgcaattctactatattcttagaaatagctaacccaagacctgatcctcctgtattagtatttctagattcatctagtctataaaatctatcaaataatttttcacttttttcttttgataaatggtctcctttatttctgaaaactacaatggctttatcatccttctcgtataatcctattaatatttctcctggtttatacgaatattttattgcatttgttattatattctcaaaaactctaagcatctttaatgtatctatagaaactgagattttttcagattcgaattttttatatatcgttaatttattttcatcaagtaacggtgtcaattcttctattaattgtgatagaaattctgctagattaactttagtctttgttagtgttattccgctgttatttagcttagtatactcgaataaatcatcaattagtagctttaatctttcagctttattgaatgctatgtttaagtattcctccatttctttttcatctttatacctgttttgaataacaagccctatgtatcccatcacagatgttagtggcgtccttaaatcatgagaaacatttgttatcaaatctgcttttgttttttctgcatctctctcagcactaattttctctccaatttctttagccatttgatttatattataagctatatttttaatttcatctgttcccttttcttctatcctataattcaagttaccacttgctattatcttaagaccgactgcaatctcatctaaatatttcatcttattattagttattacaacaaataaaactataaaaactataactgtaagaattagtgctaaagatgaatttgacgtgctaattgtattgtatgttatccttgcttctggaatctttgaatagattaaatacaccctatcagttcctatctttagaggcattatataacttttttctcttggttcaccaatctcttcactatttacatttgtcattgcactttttagtgcactataaatatctatattttcctctgcaacatttttagttttatataacacctttccatctaaatctgttatataactttcctctccatcagatacattttctaaaatatcattaatcttatcgttatcttctaatttcaaattttcttgagactctatttgtttagccaaatcatttgcagacctctcaatagaatcataatcatattttatctgcggctcagtatgctctctcttaaaaagattattagaaaaactataaaagataaatgctactaaaaagcatattcctataaccatcataagttcaaatcttatattcttctcaattctcttttttatacttcgtattaatttttcagtatactgtagtaattttgaatttggaatgtcattgctaaaagttctatgccttccaacatctttatttctcaactttatatcctacccccaaacagtctttataaatcgaggatttcttggattttcttctattttctctcttatttttcttatatgaaccataacagtgttatcagaagtcatgaattcctgattccaaacactctcataaatattttctattgaaaatactttacctcggctttgagctaacaatgataatatatcaaattctgttggagtaagtttcactatattatcgcctaacaatacttcatgtgtttctaactttattttaagatcttctatttgtattatattttcttcttctacttctaacatatttgtgttcttaccaaacatatgaaatcttctaagttgtgacttgactcttgcaactaactctaatggattgaatggtttcgttaaataatcatctgctcccatattaagtcctaatatcttgtcaatatcttcacttttcgcagataacattattataggcatttctttaatctctctaatctttaaacaagtctctattccatttaagttaggcatcataacatctaatataattaaatctatatcattatctctaactaaattaatagcttccaaaccatcacatgcatttatagtattaaatccatcactcttaagatatatatcaactaaatctcttatttccttttcatcatccacaattagaatagttcctttttccaaacattccatctccaatctaaaaattttatatctgaattctattataatttcattctaacctaaatatcttaaaaaaaattactagtagttcttaatattttataaaatatgttcatgcatatttttatgtatgactatcaaaataattaaaatataaaatatcctctatatgtgcatataatacacatataatttcctgataaaaggcatgcattgtcatagtttatgaaacctaataaactgtaattaagttcacatttgcaccatacacaaaacatgcctttatttataatgttaatagtctttctcccagttttctctttataacttgttagtctatctcacattaaactaactagaaagctcttcccattgttcatataatttttcaatagtttcttgaagattcttaatttccttatttactctctcactttcagatggattagaataaacttcttctttacaaagttcctcctgtaacttttcaagagcttcttcattttgggttatattagtttctatattcttaatttcattttgcttagccttagcttctttctctagagcctttttctttttcttttcttcatttaattgagtttttgtctttccagatgctagcccctcatatgtttcaaatctctgtggattcttctttttttcagtatagtagctataattcccaagatattcattgactccatgctcttctaattccaatattctattaattactttatttaaaaaatatctatcatgggaaattacaattaatgtaccatcatagcttaaaattgcttcttcaagagcctctctcgaaggaatatccaaatgatttgtaggttcatctaatagaagtaagtttgatttagataacattaattttaggagatttattctacatctttctcctccgctcaacttgtttatttctttaaatacatcatcgcctctaaaaagaaatgatccaagaaatcccctaagttcacttgtagttaactctggaaagtcatcccatacttcatttaatattgtcttattaggatcaagattagattgttcctgatcatagtatcctacattaacatttactcctaaaaccttaactcctgaatcacttttaactttatccattattatattaaaaagtgtggttttcccccggccattttcacctattaacgcaatcttttctcctctttttaaatcaaaagataaattatcgaataatttcttttctccatagcttttagccaacttttccacatgaagcacatcatatccacttttaacggaagcctcaaatttaatcttcgatgcgtttttttctttatcaggagcatctacaatttccattttatcaagtgccttttctctactttcagctgcttttatacttttctctctattgaatgacctaaatttttctattattgcttcttgtctttttatttccgtctgttgtaaattataagcttttaatttagcctcataatctttcttcataagttctaaagattttgtatatggagaattataacaattcacatgaccatttataacctgaaatgttcctgttgttacagaatccaagaaaaatctatcatgggaaattacaattacagttcctttataggtttttaaatattcttcaagccattcaattgcttccaaatccaaatgatttgtaggctcatcaagcaataatatatcaggatttaaaagtaatagcttacaaagtgcgactctagttttctgccctccacttaaagttgaaattagtttatcaaagtcaccttcagtaaatcccaatcccttaagaactctagatatttcccccttatatgtatatccacctctgttttgatacaaatcttgggcagttccatagtcttttataattttctcatgatatgaagcattattttcatcatacggttcattcatcttagattctaactctgtaatcttccgttctaacctttggagatcttcaaaaacaatgagcatttcatcataaatcgttttacatgaatctaatgctaaatgttgagcaagataacccaaagatttatttttatctataaaaacttctccatcatcttgtgcaatttcttttgataatatcttaaacaaggttgtttttccttctccatttgatccaattataccaaccttatctccttcatttattgaaaatgttacatctttcaaaatagtatttataccataacttttacatatatttttacaacttaatacaatcattttttatcctccagtatttcatacgaaaatccagaatttaaactataaatgtttaatttaatattaaaacgtaaatcctatatataatggattaatagtttaactaaattttctctactaaattatactatcttatcggtgttatatcaatttaactatattaagagttaattgataattttttattatctctacgtaaaatttggattattatttaatttgctttataataagttaaacacgtaatttggaggcaaaatatgactttaaagaataacaacaaatctcttacccagaataaaaaacaattaaaagaggaagagttatttttagcggcatatgatttatttcttaaaaatggcatagaaaaaacttcgatcgatgatataactaagaatgcaaaagtagcaaaaggaactttttatctgtatttcagtgataaatacgatattttaaataaattaattcttcaaaaaagtaatgaaataatacgagaaggattagctaaaacaaatgcttttggaagcaaaaattttaaagaacgtacactattctttattgattatataataaattatttaaaagataatgtttctctgttgaagctaattaataagaatatttcatggggactttatagaaaggcaataatgaaaccagaagcatataatgatgtaaagaaagttctagatatttttgtaaaaaacctaactaaatcaggaatgaacgaagaagaagctgaaatgacattatttatgatttttgaattagttggcagcatatgttttactactataatattgaaagaaccaacagatatcgaaagtataaaaccaatactttttaaaaaaattttagctatgataagcgtgtaattcatatatattgaaacctatttttaaaagctatgtaaagaaatatcttaaagattttacattatagtagttgtaaatcttcaagatatttttgtatgttaaactggttattaatagttattatttttatcgcaatatgctaatgtaagttttatcaacctttttataattactctaactatcggacgaggaattctatatgaataaagagtcgcgaatattcctggatgtcttctttcaattctagcataaattttattcacatcattatcagaattatttctttcaagatcttcttcatttaaatctaaatcaagacctcttagtgcatcaaaagtagtaggtatttcattattagctatgttattaaaattgagaccactactaattccctcattttgattatcggaataataacataattcaggcatgcctgtttcggaaggaaataaatctaaattacgattattatcatcaataccaaacgaagctttttcgtagatatttgtactcataaatgctggtggaacaaatctaatatcgttatcactcgagctgacttgagacatatacttcttatcagggttcattttaaactacctcctataaataaataatatttgcttctcttaattaatatgcataacaattatatatagtacaaaatggaaagaaaaagatatgaattttacagccctcttaagcgaacaataaatatattataggaataatatatatattggaggagatgcatatgaagatagaaaataaggaaaacattaaagacttatttgttggattagatgaaaaagtgtgtgattcagatggaaactgtatagatggaataaattttgataatgcagctacaactccgcctattaagtcaagtattgaatatataaaacaattgagcaatacttatgcttctataggacgaggaacaggtcaaaaagctgaaataacaaccaatttatataaagaatctaaaaattttttattggattttttcaatgtaaaagataaagataaatatgttgtaatatacgttagtaatacaactgaaggtataaacaaactagcaaaaactcttactaaaactccagacgaaatagtattaacctctagaatggagcatcattcaaatgatttgccttggcgaaaaagaggtaacgttgattatatcgaagtagatcaacaaggcagacttaaacttgaagagttggaagagaaactaaagaaaagcaatggtaaaataaaatatgtatctcttactggagcttctaatgtaactggttatataaatcatattcattttatagcaaaactggttcataaatatggtgccaaattgattgtagatggtgcacaacttgtaccgcacacaagagttaatattagcggggacacagatgatgatcaaattgatttcttggtattttcgtcgcacaaaatttattctccctttggtataggagtcataataggattaaaagaggatttcatggatgcagatccagattatttaggtggtggaaccgttgaattagtaatggatagagaggttaagtttcttacaccaccagagaagaatgaagcaggaacaccaaattttttgggtgtaatgagcttagttaattcattacgagttattaataccattggatacgactatatagaaaaacatgaaagacttcttttagagcacactatagaaggacttaagaaaatccctaaaattataaactatggagatactgaaaacatcagtgataggcttggaattgctacctttaatatagaggatatgtatcatcatgatgtagctgatatcttggctaaaaagaaaggaatttctgtaaggcatggctggttttgttcccatccatattgtagaaggctcatgaacgtaagtgaagatgaagctaaagaattccttgataatccagataaaaaaatgttaggaatgatacgagtaagttttgcattatataattcaattgaagaagttgatacctttttaaatgtattagaagatatctctttacgaaaaataaaataacaaattttcttgatttagaactaaaaataaatagtataataaaatttattatactattgaaaattctattaatttataggatgtataaatgaaattcttcatatatacatccttctattagttaaatattaaaacatctaagcttatgattttatacttattatctattgattaaataccttatattttggaagatttctctcaaaagctaaattaggagaatctttgattaatggctcaaaatatgagcacgcttcaggtgttacaaaattaccttctttattaatccattctatagggaaatacttaacattatttgctacatcttctgcattaactaatgggtaattcacttcataaggctcattagataacctgttaatgctaaccattttccctgattctccttgtgaagcatattgtaaagccatctttccagcattatacgcttctgttaaatcagtgtctgaagcacaatgcattgcacaacgttgaagaaccccaagttgcagtgcttttactcttgttgtaaatccagcatcaagaattatccttcttaagtattcagatacacctcctaattgaacgtgtccaaatttatcttgagaaacacaatcaaattcagaaatgaatcttccatctttatctcttattccttctgatacaattatatacactttattttgttcttcaaatctttgcctaacatcatttaaaaatttaattttatcaaaagctgcttcaggaagatatataaaatctgcaattggttttccatcaagctttgcaatacatgcagaagctgcaagccatcctgtatcccttcccattgtttctaaaataaatataccgttgtttatgtaaactgatgcatctaaatatgtctcaagcgctgttgttccaatgaattttgctgcgctgccaaagccaggagtatgatcagtgaattttaaatcattatcaatagttttaggtatacctataaaacttattccaatatcattttgttttgcatatcgtgaaagctttgctatggtatccatagaatcattcccaccaacataaaagaatgacgttatatcatattctctaagtatttctattaaactttcatattcttcactacaagaatctaaatcttttaatttatacctacaagatccaagtcctgaagatggagtaaatctaaaattatctatttcattttctgaaactgatgacaaatcaattatatttctatttaatataccctcaataccatttaggcctccataaactttttcaaaagtttttagttctttattagcatttaaaagtcctactacacttgaattaattactgctgttggccccccagattgagctattatacaatttgacatgaaatttcctccttgtttgctatactaatttggttaaatatgctatactatttagccaatagtaatatactatttattaatatacaacaaaaaaaagatttaataaagactttttttaaaatttttgcatatattaaaaaaactttaattattatagagtaagtctaattttaaaggaggaagagaaaatgaatttgtacgacattataataataggaattgcactggccatggatgcttttggcgtaacattaggaatcggtctaaatcctagaattaatagaatccataaaataaagtttttattatcatttgcattctttcagtttttatttacatatgtaggtggaagtttaggatatttatttgatacttatattacatgcatcccttccattgctggtggaataattatggcaatcgtaggaattcttataataatagatggctttaaggaaaaagaaactgaaattttaataaagaatactacttgtttaatacttggaatatcagttagtatagatgcactagttataggattcactgcatttcatgagatttcatacaatctactactttgtgttgattcaattttgattggattaatcactttatttacatgtacagtaggtttttttatgtgcagatacattaaaaagataaaatttgttacaacgtatgctaatttttttggcgggatagctcttatattttttggttttaagatgatatttttttaagatattaaatatatgtgatataatatatttaatatttagctgttaggggatatgaaaatggaaccaaaggaaattcttaaaaataaaggaattaaaataactaaaggaagaacagaaatcctaagtatattaaaaaattctgaaaacagtttgtcagctgaaaaaatatatcagatttataaaagcaacaatataaatataaatttgagcacggtttatagaactttagaattatttgaagaaaaagaaattattgaaaaaataactctaaatgatggagtcttttcatataagctaaaaggaaaaactcataggcatcatttggaatgtgatatatgtcacaaagaagttgaaatcccttgtcctatgcttcaaattcaagaattagttcaaaatgcgactggcttcactttaacagatcatgacttggttatgaagggcgtatgtaaagattgcaaaaaaaaacaataactaagttgtcttaatataagttatattttctaaaaggttttacatgaagatttgcagattgttttcaacagaaattatgataaaaactacttgtctaaggtattcttaaacaagtagtttttcaattttaatgttataaatattcaaaaagttttataattcatatactatctgcttattttcaatgaatcctgtatgatcatatctattagttctgaaaatcctatattcaaagctgctgcacttttaggaattaggctatttttagtcattcctggaagagtatttatttctaaaatgtatggtacaccttcctctgtaactatcatatcaactctagaatacacttcgcatttaagtgccttataagtttctaacgccatcttttctacttccttgtgtaactctgcttctagctcaaccactatttcttctgctcctccatcttgatatttagatgtaaagtcaaagaattcagccttaggcttaattgcaattactggaagcattttattattatatacaggacaagttatttcatcaccttttataaatttttctatcataacttcgctatcccatttaaaagcttctgaaacacagttttcaatttccttctcttctttaactatgaatgttgcaacacttgatccaccatgagtaggttttactacaactggatatcctaattcatttattttattgaaatctatattatcaccttttcttaagttaatccaaggagcagttctaatcccatttgcctctaaaacggattttgatacatctttatccatgcacatagcactacttaaaggcccacaccctgaatatggtatacctagtgtttgaagcacggattgaactgttccatcctctccaaattggccatgtaaagctaaaagtgcgaaatctatccctttagatttatttattatatcttcttttttatctattacaattggtagcacttcatacttttccttgtttatattttcaattatagattttccactttgcaatgatatctctctttctgatgatataccacccattataactccaattttcatagattacctccaaaatacttattaatatttcctgttaattaaatttattcattctaacttatctttattttattaaattaacggcacaattaaaagaaccactttgactataaattgtcttaattgtggttcatgaaaattttataaatattcttttatctgttagttttattatcataactacataaatcctttattggacattccccacacttaggatttctagcactacaacatcttcttccatgaaatataagtagatgatgcataagagtccactctttctttggtagttctttttgtaattgtttttcaacctctaaaacattttccgaatctgcaagttttaatctatttgatactctaaaaacatgtgtatctacagcaatagatggtacattaaaggcatttgataaaactacattagctgtttttcttcctgctccagcaagtgaagttatttcctccattgtctttggaacttctccgttaaatttttccttaagttgattgaacataagtattaaatttttagatttatttctatatagacctatctgttttatccttttttcaagttcctcgtttgttaatgttaaaagagaatctaaatctggataatccttaaataaatctttcgttacctcgtttacttttttatctgttgtttgagcagacaatattgtagctataagcaattgtagtggtgttccataattcaattcacattttgcatctggatatgtctcttttaatatatctacaattttttttgtccttgctttcatatcttttgtaatctccttacttataaattcctctataactttcaggtaaaagactagctatactcctcattaggatatccatacatttattatcatattcatgtttgtcttcatccttttctttagcaggaaatacaattttttcacctatgtttatagtaacatcagcatgctgccatttctctgctcccatatcgccacttttacttataggtaataacttatctgttccagacataccaattggaattatttctgctttcgccatccttgcaaataacagaattccctttttaccttctatcatagcacctgtcctactcctagtaccttcaggaaatattaaaatatcatttccctctttaagagctttaacaactcgtgtaatagcttccttatcagcggaattgggctttattggtatgttcttcactatctgagttcctaatttcgttattggatcttctgacaattttattcccattacaaaatgtggatcacttttctcttttagcatttttgataaaactaatccatccgaattactcaagtgattacatacaaatattcttggtttttttactttatctatattatctgctccattaacagttatattagcatattttcttatataattatctactattttttttgctatttttataattatcccttctggcatcattcttattaattttattgcaactggtgataacatttttctccaacctttcttaataatcacattttatattatactactaattacattttattacaattattcaattctatacaagtattacatgcataatatattattgatcattatttatatacattatatatgctttcatatgtctatgcaattaccaaaaatattaaggttattgtaagatttaacaccaattatactaatatcttcttttattattataacttatttgcaaaaagcattttaattatgaccaagataaattaatataacttatttaactttatcagaatctccatataaaaaaatacattaactaaactttcttgctctaaagtttaattaatgcatctcttaacttttagattataatacatttcttaataaaataattaataaagaaatgttgtattttaatatttagtaaaacatcttaacttagtaaaattcctataaataaatgctactgaactatacaatatacaagtttatattaattgtacttcatatacttccatattctaaagcattaaataaccatatcgttaaatattttctttttgcgtccttttaaatcactaatttcaattattgctgcacttgcactatttctaacaatgtttttagcctgaactcctattgcagttgccattgctggcacattctttacaactacagcattagctcctatcttggcacccttccccacagttataggtccaagtacctttgcacctgtacctattaaaacgtcatcctcgatagttggatgccttttccctacatccttacctgtaccacctagagttacaccatgataaagcgtcacattgtctccgacttctgcagtctcacctataactactcccattccgtggtctataaacaacccttttcctatcttagctcccggatgaatttctatacctgttaaaaacctagataattgggaaattaatctcgccaagaaaaaccatttctttaaatatagggcatgtgcaattctatatgatattaatgcatgaatacatgggtacaataataatacttctagcttacttttagctgctggatcttcatttaaaactctttctagatcgtaattcaattttttaaacacagcctattctcctttctatagttttcagtagagcttttcacatatacaattattaatagaacttcattggtatcttaagttaaatcaatcgtttcactgttaatttctgattattaatagaacttttatagttaaattaattaatcatataatcccatagatatatacttttctcccccatctggagcaatagccaatacctttttaccttttccaagtctttttgcaacctgtattgctgcatatacagctgcacctgaagatattccaatcaatacaccttcattttcagcaaatgcttttgctgttttaaatgcatcttcatctcttacttgtagtatttcatctacatattccttatcataaactcctggaacaaatcctgcccctataccttgaattttatgaccacctggatttccaccacttaaaactggtgaatttgctggttcaactgcaaatgctttaatatccgaattcttcttttttaaatttttagatactcctatcacagttccaccacttccaactcctgcaacaaaggcatctaaatctggaatgtctttatatatttcttctgctgttgtttcatagtgcttttctggattagctatattctcaaattgttgagggataaaaaatccttctccacttcctatttctagagccttttctatggctcctttcatccccttagatccttcagtcaatatcagatttgcaccgtatgcttttatgagatctcttctttccttactcattgtttctggcattactattgttacactataacctttcaattttcctataagtgcgagtgctattcctgtatttccgcttgtaggttctactattgttgcccctggctttaatactccttctttctcagctctttcgatcattcctaacgctgctctgtctttaacacttccacccggattaaatttttcaagttttacgtatatatctgcactattttcgtccttaattaaattattaatttttaaaataggtgtatttcctattaactctaatcctccattataaaccatattattattctcctcctcaaacttctactaattttagtatatctttttacattctttttatattaaatataataaaaaaacttcatcctccataaaaaattatagagacgaagtaaatttcgcggttccactctaattggattaaataactaatccctctcaattttgatacttaagatatcatatcactataacgggtgatcccggaaaatcatactaaaaaatatatcaaaaaatcaatggctatactatcgctccattttttaatatatttaatttcaaatttcaactccaaagagcacttcacataaattctagataaaaagttctcagcatccttttctctctgtaaacttcctttatgctacttttctttttcatagtttttaattcttagtgttttgataggttttatattataattatattctttctaaaaaaaaagtcaatactttttaaagttttaattaaaaagtgttgactttcttaaatatataaaaacaagtattcctgatgggtaaatactaaaactaaaatattctttttattaaaaatttaaataatttatgttctaatttttcttcttccagagcggatacaaaaattcatctattaaatcatgaataattactattccaattaatttttcgtattcatctactactggcactgaattcaaatcatattttgaggcaacttctatagcttcgctaatttcatcatcatgccttacacgtgatacagaatagtccattatttctcttatcttcaaatcactatcactaactattaaatctcttaaagataccacaccttgaacacgttcttcttcatccgttatataaatataataaataacttcttcatctggttttgtttctttcaatatctcaatagtatctccaactgtaatatctagattaacggatataaattctttactcattatactaccaacagtttcatcctcatattgcaacaattccttaacttcatctgcatcttctttttctaaattcactaatattttttctctttcctcttcatctaaatcatctaacaaatcagctatctcatcattaggcatattttctagcacttctacagttttgctgtcagatagctccttaattattgtccccttgtattctgaatctatttcctctaatgtatcggccgctaaatcctcatccagtgattccaatacttgttttcttgagtttgtatctagattttctaatatatctgcaaggtccgctggatgtagagttgacaattttttatatggtatagataatttcaaattattttcaaccatttccaaggattcaacatcatcccatcttaaaactttatcttctaacttctttctcatgatcccgtatataaatttcataataccagctatctttagtcttctgtatctcgctaattttcctgtttcaactccaataactctgtattctcctgcaatttttgcgattctcaaatcattaacccttacaacttgttttccatttatatcaactatctttttatctaatagattttctgaaagaagataactatacctcatcggtaatatttctttacttcctcttgttgtgatcttaattttaccatccctatttaaaaattctatatatctaaactcataatgaaaggctactccgtcctttttaagcttatatccaattattctaggatatccatcctccgtagtcacataaatgtctcttagagttcctaaaacatcaccaaactcgtcataaacttttttatctagaatgttagtatatagaaatatagataattccatcttaattatttcccccctacttctgcagaaagaaaatccttaagtaaaattagtattgtaactaaattgcatctacttatatcttttaaggcaagataaaagattttccttctgaatatatttagtttttgctatattatagtttatattctgaggtccttcctccatcttttacaccgccctgtatatcttcacttagttatattttactactatctctaattattatattacatagaagtaaaaaggcaataattttttgttttgatttatcttttgaacacataaaaatttctttaattaatcctcaatttgtaaattataaatatttctttatgagttgcattgaatttacactacacttgcctattgatattgtttgtaaactaattattgttatgttaatatactttaagaataagctttaaaagcttattcatttgacttttcaattatttattacgttagtataatatcccaatatagcgatctttaatatacgtaattttaatataaatatgctttaagtaaaataaattaagaattggagttaatattatatgaagctttgtaaagaattcttacctattagtaaagaagacttgaaaaaaagaaaaattgaccaattagattttattattgtttctggcgatgcttatgtagatcacccttcttttggtactgctattataggcagaactcttgaagcacaaggttttaatgttggtattatagctcaacctaattggaatagttctgaggatttcaaaaaattaggtaagcctaaatatggtttcctagttaattcagggaatatagattctatggttaatcactatacagccgcaaagaaaacaagacgtgaagacttatattctcctggaggagaggctggccacagaccagatagatcaataattgtttactgcaatagaatacgtgaagcttataaagatgcagctattgcaatcggaggaatagaggcaagtcttagacgctttgctcactatgactactgggataacaaagttagaagaagtatccttgtagattctaaagctgatttattgatgtacggcatgggcgaaaaaaccgttgttcaaattgcagagttattaagatatggagcaaatattaaaaatataacaagtgttcgtgggacttgttatttgactaaagatatatctaatattaaaaatgcagttatagtcccttcatttgacgaagtatctacggataaggaagcttatggtgaagcttataaattagaatactacgaacaagattctataaacggtagaactataattcaacaatacggtgatagatatttagttcagaatccacctcaagaaaacttaactcaagaagaaatggatatgacatatgatttaccttacacaagaacctatcaccctatatatgaagaaaagggggcatacctgcaatacaagaagttaaattttctataacaagccatagaggctgttttggctcatgttcattttgtgcgctaacatttcatcaagggagagtaattcagaatagagggcaagagtcaataattgacgaagcaaagcttttaacgactttacctgacttcaaaggatatattcatgatattggaggtcctactgcaaattttagacatagagcttgtaagaaacaaatagatcacggtacttgcaaaaataaacaatgtatgttccctagtccatgtaaaaacttgataatagatcatactgaatatctttctctcttaaagaaagttagaaaacttcctggaataaaaaaggtatttatacgttctggtctaagatatgattatttaatacatgataagaatgatgcattttttaaagaattatgtgagcatcatattagtggtcagttaaaggttgctccagaacatgtagttccaaaagtattgaatcagatgggtaaaccaacaagagaagtctatgataaatttgttaataagtattttcaaattaataagcaaatagataaaaagcaatttttagtgccttatttaatgtcatctcatccaggttctgatcttaatgcagcaatagatttagcattatacattaaagagatgggatatacacctgaacaagtgcaagatttttacccaacaccaggaagcttatcaacaacaatgtattatactggattcaacccaattaccggagaaaaagtttatattccaaaaacacccgaagagaaagaaatgcaaagagctctaatacagtttgctgttcctaaaaattatcaaaaagtaaagaaagctctacttaaagctcacagagaagacctaattggcaatagtaaaaactgtttaataggctttgctcctggaaaactaggctatcaaggtaagcataaatcaaacgatggtcctaggaataactcaaataaaaattcaaatgttagtagtaaaatatctaatgaaaaaaattctatgagtaataataagaagaattcaactaatagcaataaaaaacactcaaataaacattcatctgataattattcaaatagaagaaaaggaaccatataaaagaaaggatacttagttgcttgatattgcaactaagtatcctttctgtctattaaccgttagcacatattactctcattcaaaaaatcctctacacacttataacaacttatcttagtattttacctgctgtttacatactctaaagcacaaattcgtactcaattcgtttcctaggaacgataattgttctttggcaatattttaaagccctttaatactaaatttataattataagaaataacatatccccaattaccgaataagggaagattttaattccacctaaaataataatatcttctatcattactattaatattgctataattaataaccatattccttttttatttgcatatggtctatccaataaaattacatttagtatgagtaatgcaccaagtagtattagcgaaaacaaaaataaaatagtttccttatctatctgtaagataaatccatataaataatttacctgaactgtcaactttgaagtttgcattattacagcataaataatacatactgttgctgcaataacatatgttccaccaaaatttaacttctcagatcttaaataaacatagcttacagctagcactataagaggcactgataaatgattcaaaaatattatcggttttaaataatatattattgtactattcttgagtatacacaataaaaataatgctatatgccttaataaaaataatgtaattactaatgccaaatatatttttattttctttggtgaaacctctaaattctttcttataagtgaaattgacaaaaaaattataagtaacaaaaataaataatatgcaaaattcactaattacgctccattccatattcctgttacttatatttattactgtctatcttattttatacctaaaagtttaattccacccttaatacattgaaccctcaatggaaaatcaggccctctttctccatcaatatctgtaacaatgtcttctggagattctatatataaatcatctgttttaaaataaaccactttatccgaatctaaatgctcgccttttaaaagctttataaaaagtggtattagctctattatttgtatagccttaaatattattacgtcgagttttccgtctgtaacttctgcttctgtagctaagttaaagtttccagcagttttaccattaaaaaccaaaagtaaatacatttctccgtcataatcacactctttagatgataattttatctttaactttctaaagttaggtaattcctcaagaccttttagataataggctaactttcctattgtattctttaaatttacatcagttttttgagatacatcagtgaaaagtcctgagcttgctacatttataaaatacttctcatttattttcccaacgtcaacagctactggctttgagcttaatatttgcttacatgcttcttctatatcatttggcatattaataaactttccaaagtcatttgcagttccaactggtaatatacctataggtatatttatgtttttatttttcatagcatttactaaagaatccactgttccatctccaccagctattaaaatatagctataagtttcatctattatatctaatgcctctgctaaatctttacctttttgaattctatatggcactactattaatcctacttcttggtgtagttttataatattgtctaattcgcttattatactattttctcctgagtatgggttgtatatgaatctaacctttttcataaattaacctacctccaataaattttcttaaattattatttatatacataaaaaatagccttaaaataattcttatatacaagattataattagctctaaatacatatattaaattcctataaatatttacatataatacctttgtcatagagtttattatatcattttacttacttaatgtcgatactagataatcttaataaaaacttaaagttaattttgcaccttatattattttcatttatgtgctataataactctttgtaagtattttttataattttaggagtgattttatgaggaaaagttgtattcctaatgtatttacctttattaatttatcttgtggaattatatctatattatcagtaatgaatgaaaagtatgcaatatcaggtgcatttattttattagcaggattggtagatagatatgatggaagaatagctcgttttttaaacgtttctagtgaattaggtaaagaattagattctttagcagatttggtttcatttggagtagcaccatctatattagtatatatattatttaatcttgaatcttttggccctaaaggattatttggatttatagttttattactatttccaatttgtggtgcctatagattagctagatttaatactactgattttgacggcgcttttactggtataccaataacaatagcaggttgctttatggcattcttttcattaattatatttaattttaatattacaccatcgatttatcttgttgttcttttgatgatccttggttcatacttaatggtaagtaaaattaaattaaagaaattttaattataattcataataaaaaactctatcctaaagtttcaagatagagttttttttgtttagttttcatcattattcttctctttctgagttttgaaaattcaattcattatctatttcagtaaatatcttatctttctctgtacttactgtaatatattcatttttaatcttgcaatactttagataagaaccttcgcatcgttctaaagtgcttatcaacttatctattaattcacctacattttcaactctctctagtgctttcttaacttcacttttctctgctaaatttacaccatatagttctgatgctccagcaattaatagtctataaacatccacataattctttaataatacacttaaattatcgatatcttcatattgttttttagctaaatcattaaatctcataattaatcctttataaaaaattaatactatctaaataaaatatttgtagttaatccctaataagtgactaactacaaataatacattacattcttaatgtttcaccatcagcatattcattatctatatcgttaaatatattgttagagctataatgttcttcttcactttcaactatatcatcaaacttatatttttcatggtaaggtttttgaagcaaatcttcatctaaatctaaaaacatcattcctttgtttgaaatatcttcatcatggtacgtgctcatctgaaacattttattttcttgtggcttttcactaggagtcatactttcatcaatctgaaaatacttaaactccaaacttctgttaataggcttctctttcaaaccctctacataaaccacaggaaccacaaattcttcaggatattcataaatcatatgttttccccctacttacaatcctcattacataatcttctaaaatatgctcttggatatctacataatgggcatttcataggtgcttccttaccttcgtatatataaccacaatttagacatatccattcttcttctctatctgatttaaacatcttaccttctttgagttttttagctaaatctaaaaatctctccttatgatgttcttcaacttcttgaagttctttataaaaatctgcaatgtcgtcaaaaccttcttctctagcaatttcctcaaattctttataaattactttactttcttcagattcactaagtgcagattctatcaaattattttttgtattattaatcctatctaaatatcttctaaacacttctcttgcatgagctttttcattacctgcagttgcttcaaatacctctgcaacatagaggaaaccatcatccctagctttctcagcataaaaagtatatttatttctagctctagactctcctgcaaatgttttaaataaatttctttcagtttgactaccttttaagttcatctttgtctcccaaaatattactttctctcatatataaactattcatttttatacttttggttacctcataagttaactcataatgatgaaacatgcttattggcttaaatcataaaatattgtttattacttttttataattccgatcttttaggatacaattatcttcttttcctgattacaagttaaaatcacttcttgcttatcgcttgatttagtaattagcctaacatcatgcccccataattcttgaacgtacttcaacgtttcttttgcataagaaagctcaagtggtcttccgtcaaaaacattttctagggttaatgtataattcttcttattcaaatcaacaactctaatatatggtatattccccataccagcagtataacttaaagtatctctaatagttttccagccagtttcatctgaaatttcttcaatgacaacatcaaaagttctttgattatattgaaataaatttaattcttcgcacaattctttagttaaataacgtcgtaaaaatgaagaatctctttcaatttctcttacttcaaatattttttcctttccgtatctcttttcaatatcttcaaatactttgaaaccaacataataaggatttaacccgcctatagcaggagctattacatcattatgccttttcaagaactctaaatgtagttcttgtggcaattctaattgttttaaaatattatagtgtgtatagcttgcccatccttcattcataattttagtttcaatttgaggaataaaatattctgtttctctcttaacaattcttaatattgttttctgccattcttgtaactgaccataatttattataaatcccatgagatcatcaacaggttccaatggaatcttatctaaatctggtaaactgatttcttcataaggatctaaaatatctctattttcttttttattttcataatcttttaaaatattttctttaatctcattgttagtcagttccttaactccaacagttcttttagattgataccttatcgcatgacctgcatctagtattctttcaacttccgagtatccaatacttggatcgtcaatataatttcttattattttggcatctaaattaaacatttctaaagtatatttagcattagttccttctttaaataatctgttatttctgaagaagtcattatgcccatatacatgggccattgttaatatctgtaacaataacgtattatccttcattaaatatgctaaacaaggatctgaattaataaccatttcataaggaaggccagtaagatttaaagaataaagtgttttacttttctcataagatttaccaaaactccaatgtggatatcttgaaggcattccaacataagcttcatatccaatcatctcattaaagcctataatttcaaattcttgaggataacattctagcccatattccctaacctttttctctattttctcattccacttttcaatatcattaaagctatattccaatttcttattcctcctttaactccttcctaagcataatcttaagtgcatcccataagtccttcttttcttttataattacaggaacaaatttttcattagtgatctcttttttgaacttatgatacattgtagtggtatatgtggatggtaaaagttctgcatagccgaacatattgctaacctcacatatatcttttaccgctgcaactgctttttcattatcttcagaccagttatctccatcacttgcgtatatgctatatatattccatgctgccggaggatacttctcttcaatcacctttaatgcctcattaatgccactagatatataagtaccaccagattcagacttatggaagaattcgaattcatctactctctttgcaactgtagtatgatatataaattcaaatgctatattgttatattttctttttagaaaagttgccaacacgaaaaaataagatcttgctaaatattttttagtcacatccatagaaccagaagcatccatgataaatagcattactgcattgctatcttttttaggttttaatttaaccctatagtacctaagatcctcctctctaaaaggaaatctttctaactcttcgtcactttctaattcctttaaagctctcttctttccctgttttcttgctatctttgacataactgttttcttttttgcaagtcttggtcttattccatgagtttgatatcctctcttcttgccgctagtttcagtaactatttctgaatactttttttgatccaaattaggtagattaagatcttcagatatatagtccattagctcctcgagagtgatttctgtttcatatatatcatcaccctcttcatttccagctccctggtttcctttagctaatttcttatttccatttcctaatttttctccccttttttcgttacctactccactggccactcccttagagttctttccatagacgaattgatattccttaattcctttaattggtatcttaaattttttgtttttactctctccaactatactctcttctgataatatatctcccaaattttcttttattgatttttctacaagttgcctatgccttcttctatcttctatggatctgtcgtgatcaatttgattgttagtgtaatctctaaatattgccataagctaatctaatccctccataagttattagctgcatattttaagattacgtcacaacaatgaagacaatatccgtttcttttcatttcttcaaccatagaatcatatttctctgcttgttccttatccctaacctttgatttagttatgattcttgataaatctttaactgaagctgttaatttcttttctattgcttccttcaaaggctcataagaagtataatctaattttccgcctttcctaactatatagaacatatatgaagtcacatctgatctaaagcctttagctgatgcggcatatacacctatttgctcttctatgcttctcataaattcttcatctggattaagttcttcaccagttgaaacatcttttatcttagtcttatttacatatgcctcagcattatctatataattgttaaataaactctcagcttgttctctaaatgagtgaataaatgcctttgtaatttctctttcaagaattttattatattcttttcttatattatcctgaataaagcctaaatacttctttttatcatctgctgcaatatctagttctctaacagattttattatactttccattatactaagtggatttatgcaatcatatcctgactcagcaagtgcattatctattgcttttatgataaatcttgtacttattcccttcatgccctcatattgaccggcttcttctctaagttctccaatatcgatcttctttgtagttcctttttcaacaatctcttctccattgtaaatcttaagttttgtcaccgcgtctactttagctgaaggtgttaaccttgaaagtattgcaaacatcgctgcgatttcaatagtatgtggcgctatatgcgctttaaaattgctcttctttattattttttcatatatcttaacttcttcatctagttctaagcaatatggaacttcaacttttacaattctatctaaaattgcttcatttgtatgatctgatttaaatttattccattctgcctcatttgagtgagcaactataactccatcaaagtaaatcattgaacccttacctggagatggtactgatttttcttgggttgcagtaattattgtatgaagatattcaacatcattcttaaatacctctataaattctactagtccacggttaccgacattaaatgctccatttagagaaaaaattcttggatcatcttcagagtacatatccatcttagaaatatcaattgatcctgttagtattgatgtatcttgattattgggatcaacaggtggaactactccaattccttttcttgatctaatagaaaatcctgttctttcaaccggaaaatcttcataaactcccttaagttcattaacaagtttatacctgcatactgggcataaatctccttcaatttgtactcctagcatttcctcaaattttggtcttaaatgctttggaattaaatgaagaggttcttcatgcattgggcatccctttaatgaataaactggttcacaactttctaaagctgattttaaactctcaactattgaagatttacctgctcctactggaccaacaagatataatacttgccttgattcttcacctttcatggctgctgatttaaaataacttgcaagtttcattataactttatcaattccgtaaaaatcatttttaaaaaagccatattttcttattagatcatttccataaatttttcttactcgagggttttcttcaccttttaactcctctacgcctttgctcataatcatctcatagattcttttatgagcaagattaacaacttctggattctccttaacaatatctaaatattctagaaaacttccttcaaacttttgggtgttagacttttctctatctgtttctataaattctttaaagttcatactcataaacactcctcctcctttataactaaaatatattcaattaaacaaagacattatgactacttttttcaaatacttactgtttaattcctattaaataaaaacctaaacaataaccatacaaatttatcacttagtgagtgttatttcataactttattaaataacatccatataataattttgtttttcactatagcctgtctaatatatagatattttgatatttctaattaataactaattattaaataaattaataatatttcaaatttataccttaaaacattaaattcttttgcactaaaaaaggaatattttaagttttttatactcaaaatattccttctttaactattaaattgtttggtctattatacaattcacatttcagaaatcactatgaaatataattatataatatttacaatcgtgcctatgtttaatatctctgctattagtcaaaagttcttggagtaaattcagaatctttcgcttttggctcgccaaaaactgcttttacgctttctgcctgtggattatgatttaaagtcttatgtttgcttgtatgttttcttttcatactgttgtccatttatatcactctcctcttcctattgactctttaatagtatgtgtatttcggactgttttatgctggctaatgttgtgtatatttagttttctatgagttcttttatatcatcaactgacgcacctattgtaaatattatattctcatcaattcttaatttactttcattttcgttaatttttattttgttaacagttaagttatttggacgcaattctttgtatctagtacttgatatatctatatcaaactttttatctttagcacctgtaatttttattacagatccatgctcattaccatcatgctctacacttatatctataatgttgtcttttccattgcagccacagtttgaatcatttggatactttaaaacattagcattgccagttattgtagcccatccaccacttaatgctaatttcactaatatgttcaaatcatatttatcctctattttctttaaaagttttcctaattcaaatattgttaaatctagtttcatttgctagtctcctttgcttatgtaatatatcatctattataattgcttttataaaaaattaataatttaattttcctctatctatatacttgttaatataaaatataaaggatatatcaaacagataaaaacattttgatatatcctctttatattataggtgatccttttctttatgtggaggcgcacctatcttttttccatcaataatgcctaaatccgcattatttttaggatctatttttctacgttccgcattagatttaggtctatcttttattctgtttttattattatccatatgtatcacctcattattatggtgtacatttaaattcattttatactgctggctttaaaattaaaatttattcaaataattattaataaaattaactattgccaattaatatggttatctattattcctgaacttacctctttcatattgctcaggccattttacctcaccatctaattttgaatcagcttcaagcggccagtatggttttcttaaaagaattcttcctaagaaaatcatatctgctctatcattttgaattatttcctctgccatataaggcgatataataagtcctccagctattacaggaagtcctgtattttcttttattatctctgcaaattttatctgatatccttcatataccttaattggaacaggagttggtgcaacgccacctgagcttacattaattatatcaataccttcttctttaaccaaatttattattttagccaaatcctctggatgatttccttcatttaaataatcttcagcacttatcctaagtattattggtttttccttggtccacacttctctaaccgcttttactacttcttttaggaatcgcgctctattttctaaatttcctccatactcatcagttcttttgttggtaagaggagataaaaattgatttattaagtatccgtgagcaccatggatttctataatatcatatcctatttcaatacaccttttagcggcacttttaaaggcatttattacttcatttatatcttctttactcatttcctttggaactttatattcactactaaatgcttcagcactaggtcctataatctcaagattatttatttcacactttctacctgcatgaccaagttgaattcccataaccgcacctaagcttttacatgtatcaactatcttctttaaaccctctatttgtgaatcattccatattcctaaatctttatcacttattcttcctctactttcaactccagttgcttcttggattataagtcctactccgcctaaagctcttgtagcataatgtattttatgccactcagtggctattccatcttccttagctgtatacatacacataggtgccataacgattctatttttaaattctaaatttttgagtttaaaatttgaaaaaagttttgacatataattcctcctcccttttgtttttatatttataatgttaattatattctttcctaactaaacaattggatactgaattttaaatattaattaaccatataaaatcattgtaaaaaactacagcttattaataatactagcattatatgccgccccgaagccattatctatattaactacgctaacaccgctagcacaactattcagcatagataataaagctgcaattcctccgaaattagcaccatatccaacacttgttggcactgctattactggcttatctacaagtcctcctacaacgctcgctaatgcaccttccatacctgcaattactataacgacttttgccccctaatgacatccagttttgaaaaaagtctgtgtatccctgcaactccaacatcagttattttttcaactctattgcctaatatactcgctgtttcaaatgcttcttctacaacaggtaaatctgaagtccctgctgcaacaattgctatataattctccgtaagaggttgttcatttttcctaatagttattgttctaccaagtttattatattttgcttcttcacatatttctttgactgcattatacatttcctcattggctctagttcctaatatattattattttttgtaatcataaattttacaatatctctaacctgctctacagtcttaccttcgcagtatattacttccggatagccaaccctaatttctctatgattatctattttagcaaaacctaaatctttaaaaggtagatcttccaatttttcaagtgcctcatctacattcaacttgttatttttaacactttctaataattctttaatttcttctttgttcattagctttatcctcctgagatcttctacactaccttattacaccattttaatttatctctaaaatattactatttattttgattatcttctttttttactatagtttcattaaaacttcctactctataaccttgcaaatctaatgttacatatttaaatccacattcttttattttttcagcaatagtatctaaaagttcttcattaaatagtttacttctatcattcctgcttacttcaactctcgctaaatcaccatgacatcgtactctaacagctctaaaacctatactcatcatatacttttctgcattttcaatcttttcaaaatcttctaccttaagctcatttccataaggtatccttgtcaaaaggcaagcataaggtggcttatcccaagtgttaagtcccaattctttagagaatgctcttatttctgctttagttaatttacactctaatagcggacttcttacttctagttcttttaacgctttaagacctggtctataatcacttatgtcatcaaaatttgtcccatcaattacacaattataaccttgttcttttgctacatttaatatcatagtgaatacagctgttttacaaagataacatctatcctctggattaaatttaattgaatcaataattggagcctcaataatttcatgttgaactcccaattcccttaccaattctctagcctctgctatttcccacttaggaatgtaaggtgataaaatcgttactgcctttacattgtctccaagagcttctttggctactctaagtaagaatgtgctatctactcccctgagaatgctaaaactacttttcctaatcctttaaggtatttcactagttcactatatttatcattattaatcatctatctattccgcctctcacctatacatttttattttctcaatttgattgtagaattactcattataaatattcgaagtttgcttataaacttccctatacaccttttccatagttatgttattctcttttgcaatctttttacattcctcatattccggcttatatttaactaagttacctttataatatgatttcttgattgttacttctccatactgagtttctacctttgaaaactctctatttaacattattttttcaactttatattttcttacgcctatagatgtcgtctcttcaaaaactatgtccaaaatatctttttctattttttcactaattaatacacttaactttattcctggtcttccttttttcatgaatataggagttttaaaaacatctaatgctcctgcatcaaaaagcttttcttcaatatatccataaaattctgggttcatatcatctatattagtttctaatatatactgttcttctatcttctctaaactattgtcttctcctaagtaaactctcaaaacattaggtatatctagatctctatgtccaattccatatccaattttctttatagagaaatctattttcgaagtaaattcttgaacattttcagctagtatcgcagctcctgtaggcgtagttgtttcaaattgaactaccccaacatttattggaatgccttttaatatttctacggtcgcaggtgctggaactggcatgagaccatgagcacattttacgaatccgccaccaacttgaacatgagatgccataatcttatcaacttttaaataatctaaacaaatagcagctcctactatatcaacaattgaatcaatggcgcctacttcatgaaagtgtacttcatataatgttttgccatgtacctttgcttctgcttctgctactctcataaacatatttaaacttaaattcttaactttttcacttaagtcactagaatttattatattctctatatcttttaagtttctatgatgatgctcgtgatttcctgaatggccatgaacatgagcttgttcgtgattatgtgaacaatcatgttcatggctatgtggatgattgtgttcatgattatgtgaagcatcttcaccatgagaatgattatgatgatcgtgctcttgatcatgtacgtgagagtgactgtgatcttctataatatcagtactgcaattctcaaaatctttatatcctatgttatctgaattatttacttcatcttttaatataacatctactcttgttcctgttattccaagtttctcagaactgttaatttgtatatcatattcagaatttaaattaagctttgaaatttctttaaataaatattctttaggaactcctaagttcaacatcgctgccagattcatatctccacttataccgcaaaaacaatcgtaatataatattctcatttagctcactccttaactcatttgtatgattttaataaatttatttttgtctatataatgttatatcttcttaattatcgaaaaaatactcttttgaatatatacatttttttctttttttggaatgtaatcatctttttcaactgtctagaaactattttgtgaattgtaatattttactttattcaaatattgttttaacattttttaattcttgacgaatcttgattgcttgaggacaatggccttcacacttaccgcattcaacacatttatctgctctttctgatggtgctactccattatatctttccttaagttctttttctgttgctggagtaacgaatatattatactcattatataatgtaaaattcttaggaatatttacgcctgctggacatggcatgcaatactcgcaagctgtacaattaacttttattctttctttaaatgcttttttaacattatccattatttctagctctttttctgttagtgaatttggtaaaacttcacctgccactctaatattttcagtaacattatccattacattcataccacttagtactacagatacctctggatgattccatacccatcttagcgcccattcggctggagatctcttaatttctgctttatcaaatgtatcagtaactacatccggaagatttctaactatttttccacctctaagcggctccatgataacaactccaagacctctatctgctgcatattttaagccttcagttccggcttggaagtcttcatctaaatagttatattggatttgacagaatgaccaatcataataatccactatctctttaaaaacttctaacttatcatgaaatgaaaatcctgcatatcttattcttccatctttaattgctgagtttaaaaattcatctattcctaacttctttaaattttcccaggaacctttatttaaagcatgaactaaatagaaatctattctatctgtttgcaatcgctctaattgttcatttaaatatttatccatatcctctctagtcttaattgcccaactaggaagttttgtagctaaattcaccttttctctatatccctcttttaaggctctacctacaaatggttcactttcccctccatttcccattcctgttccatggtaagggtatgcagtatcaatataattaactccttcatcaattgcgtggcgaatcatttttgtagctttttcttcgtcaattttagtagtatctccatcaataataggtaacctcatacaaccaaatcctagaactgaaaccttttcatttgtctttccaaaccctctatataacaaagtaattcctccttaaaatagataatttatatgataaattgttctatatatattttacatcttatagttaactctaagtcaacatattttggaaaaataaacgctaaaatgaaaagttaatttcgttattgcagcactaaagtcattgttctaaaattaaaaagtaatttttatttataataccatattcatgatttataacttttcattttagaaacaattttttgatgcaattttacaaatgcttactcttagagtatactctaagttataaaatacatcatgcagtttaaaggagggtaatactatgggatacagtattgctgaagttgctgaaaaaacacatttaagtccacacactcttagatattatgaaaaagaaggtttacttccatttgtggatcgcagtgagtcaggcaacagggattttaaagaaaaagatttagaattgcttgaacttatttgttgtttaaaaaatacaggtatgcctataaagcaaatcaaagaatatatccagttatgccttaaaggtgataatactattgatgttcgtagagaaatatttataaaacaccgtgaagaagttattagccaaatagctgaattacaaagaaatcttgataaaattaattacaaaattaatttttataattgcgcctgcaaaaagactgtataactgagataatacagaactttatataataattaatccaaataaaggatactcattgttaatcttggtaagattgcatacaaagattatcctttatttagactttttcataaattacaaatgaataaattgatattttattcaaaaaattcatctgattttttaatttaaaaacttaattttaattaatattcttctaaaatttatatacttctaaaactggagctagtactatagtcctaaaataatctttatttccttaacatgagatctgctcaccggtatttcattattttcatcatcatcaataattaacttataagtaccgttaaaccaagggtaaacttctttaactttttcaagatttactacgtaactcctgtggcatctaaaaaaatttgttttctccgttagctcttgtaaagtttttgttgtacaataaatatctttattagtcttaacataattcctctctccctctgaataaaagaaggaaattttgttaacatcgataagaattatttttccattgttctcacacgggatttttttcaatgcttgtttattttcaagcttacttaatatattgattatttcattttcatttctattactaattgtatttaacgcacaatttaatgattcctctattctcttttcatcatatggctttagtatataatcataaactttaagttcaaaagcccttattgcataagtatcatatgccgttaaaaaaattagaattatatccggaaatatctcttttacatcttctgccaattttattccgttttttcccggaatattaatatcaataaaagcaatatctggctcctcgctttcaattaaagttaatgcacttattccatcatatgcttgccctacaactttgaatctgccatccttagatattatgtattttaattcatcgctggatattgcttcatcctcaactattgctacttttatctcatctagtaatttcaatttaattcccccattaattataataattattttggaatgttaaaattaacactacttccattatttgaacttactatatttaaagagtaactttctccatataataatctaagtctattgttgatatttttaaggccaagtccagttgataaagattcatctgcattttcaaagcctaccccattatcactaatttcaatactaacgtcattttcatcatttctaatagaaattgttactataccaccattaatttttttcagtattccgtgcttaattgaattttccacaattggctgaagtacaagtattgggaattttatatctagtaaattatcatctattaaaaatttcacttctagtctatttgagaatctagcttgttcaattgctacataagcctttatcaaagccaattctttttttaatgtagaaaaatccccttctatttctagcgtagctctaaaataatttgaaagatttaatataagttctcttgccttttctccatcagttctacaatatgcacttatcacattaagagaattaaataaaaaatgaggctctatttgtgcttttaaagcctttaattctgctactttattttcttcttttaattttataagttttacttcaccatcaaccaatttttttgagctttcaattaccataactattaaaaatacaccaatagaatttataagtatcatagataatgctattgttttctcaagatctattgctgaatttatatctttagaaaacattaatataattatcatttgagtaatttctgctactactgctgctaaccctgcaacagctgggtttagcccctttttcttaaataatattctaaatcctccacctattgcgccttctacaattgttgataatccgcaagctaacgccgtaaatcctccaaatgaatacctatgcaatccacttataaatccaactataattccaataacaggtcccctaaatatcctgcaactattgctccaactggtctgctatttgctaatgattgatcttttatatatattccaaaataagttcctaaaatagcaaggagtgaaaatatcagaatcatcattatgttatcttttctatcaaacttgtccttaacgaaacacttcataatattagtctgtaatattacatatataaatattgttataagtgccattctctctagcatattcaccatcaacatactatcacctccctttcacctctatatacataaattatactactatgtaataaaatctcaatttttcacttcctttatataaaaacttactgcaaaccgcctcaatattttgttaattcatccactgaatatagcatttcacatacaaaatatagtcactatttatttataatgttagattatatatgtaagaaaacatttacacaaaggggatgtagatatgaattctattgttttagttatcattggtgctttaattctaatactatcatacagattctacggtgctttcattgctgcaaaggtattggttttagacgaatctaaaaaagttccttcagaaatatacaatgatggcaaggattatgttccaacaaataagtgggttctgctaggtcatcactttgcggctattgcaggagctggtcctcttatcggacccgttttagccgcccagtttggttaccttcctggtactctctggatattgattggttccgttgctgcaggtgcagttcatgacatgataatgcttttctcatcagttaggtttaatggtgagtccatagcagaaattgcaaagcatacattaggaaaaagaattggctttattacttccatttcagttatcttcatattaataattacaatggcaggtcttggcttgccagtcgttaactcgctttataatagcccttggggtacatttacagttggggctactattccaattgcaatttttataggaatttatttaaaatacattagacctagtaaaataggtgaggctactataataggtatggctttaataatgcttgcggtcatctttgggccacaaattgaaggtacaactcttggtaattttttgactcttgatactaaacaactatctgtaatattagtaatctatggattctgtgctgcggctttgcctgtatggttattattattacctcgtgattatctaagtacttatatgaaacttggagttattggtgctttagttatcggtataataatagtcagaccaaatttagaaatgcctgcactaactcaatacgttcatggtggtggtccggttgttagcggtaaagtatttccgtttttattcataacaatagcctgtggtgcgctatctgggttccattcacttattagcactggaactactccaaaactaataaagagcgaaaaagatattcttccaataggttatggttctatgttacttgaggcttttgtctccctaatggcattgattgcagctacctcattgcctacagctgactattttgccataaactctttgccagaagtttttgataaattaaatttggtcccaaaagatttaggaatgctcgaatcacttgttggtgagaaacttgctggaaggcctggtggatctgtgtctctagccgttggtatgacatatgtattccaaaagctacctggtgcatcaaccttaatgtcttattggtatcatttctgtataatgtttgaagcattatttattttaacaactatagattcaggaacaagaataggaagatatttattacaagatctttttggcaaaatgtacaaaccacttgctaaaaaagattctaaatttaatctagtatttttcagtgcattaatgtcacttagctggggagccttactttatagtggtaacatttcaactatttggcctctatttggagtcgccaatcaaactcttgccgcaattgcttttgcaatcggaacttctgtacttatagagatgggcaagaagaaatatacccctataacaatattacctatgatatttatcgctataacaacttcaacagcttctattgaaaatatctttaataactatattccaaatggtaagactacattaaccgtgttatcagttataatacttgctatgttaattataatcctatatgaatgtattaaatcttggaaaaataattggaataagcatcccagtgataaaataaactccattactcaagctatccaataaatgcctgataaaattttagtggagacttatatgattgatattagtcatataagtctccactaaatcatttattcttagattctaagctacattttaaatttactttttattaggttctttgtattcaacaccttttgtatcaacagttattgatgtaattacaacatcctttttaggtgcatcagcagaactagtttctacattttgaattttatctactatatctaaccctgatattacttttccaaaagcagcatattctccatcaagatttggtgcatctcctgacattataaaaaattgacttcctgcactgttagggtcttgtgctcttgccatagataatactccttttgtatgctttaaactgtttgcaaaaccattagaagtaaattcaccttcaattgaataacctggcccaccggttccatttccttgaggatctcctccttggatcataaatcctttaattactctatggaatttcaaattgttataaaagcctttatttgctaaatatataaagttgttaacagtatttggagcaatttctggatataattcagcttgaatttctccgaatccttctacttttatagtagctattggcaggtccttactatttgctgatggagttgcctcattgctttcacttgttttagaggaattatctgcttccccttttccattgctagcatttttatttccgcaacctaccaataaaaatattcccattataattgttataaaaacaaaacttttcttcttcgtaatcctcataactttttccaccttttatgtatattttgacagcttaagtatatcataattctctatattacttaatatttattatagaagtaatattactatattattattttttattcatcatgcaatttgattagtaaaattacgctacacacagtctataattttatcactaaatatttttaattttggtatatactctttaataattttatttcccttgcatatccgtcaagctcatttggtgtctcaaggaaaaatggtaaattgcacaacattggatgattaataatattcttaattccctctaatccaatagaaccttctcctattttttgatgcctgtctttatgacttccaaatggattcatactatcatttaaatgtattgcacataatttatctaacccaattatcttatcaaattgttccactactttatctaaattattaacaatatcataccctgcatcatggacatgacatgtatcaagacaaacacctactttatgtgataattctacattatttaaaatctcttttaattcatcaaatgtgcgtccaatttctgtgccctttcctgccattgtttcgagcaatacagtagttgtttgttctggcttaagaactgtatttagcatatctgaaatatatttaattccaatctccacaccttgcttaacatgactgcctggatgaaaattataaagattattaggaatatactccatcctttctaaatcatccttcattatctctactgcaaaatttcttgtgttctcatctgcagagcaagcatttaatgtatatggtgcatgacctaatattttagagaaattattttcttctgctaactttaaaaattcttttatatctgtttcatctatagtctttgctttactacctcttggatttctagtaaaaaattgaaatgtatttccgcctatactaatagcctcttctcccatattcttgaatccttttgaagccgataaatggcaacctatctttaacattgtatttcctccccgtatcttatgtaatgcaatatatcttcataatattattttaattactacatgtacttttgcctatataatatttttatattccttcaaatttaaatattataatctctctttaatataaatttttctctttacaccccgtaaatatatattacactcaatttcctaaattacaatcttattttaacgcttagcttactataggcctaattgtaaatttattatagcaacatatataaatatctttatgaaaaaaagactgctacaaaaatttctctgtagcagttttaataaaaatttaaaattgtgaaagcatgattatactatttaatattcttgtatgtgattattggtttatacttaaatactggcgaaaattattatttaatttcttttatttcatttatcttagatttataatcctctattttattgttaaataatgcagatgtacctaaaacataaacatctatttgtttatgttttaattccttaactgtctctttatttatgcatccatcaacttctattaatggtctattactaagtgttgataaatatttatttaattcatctaacttatcaataactttataattaaacttttgtcctgaaaaaccaggattaacagtcataacaagaatcatatctatatcctgtaaatatggttttacgcgttctaatgacgtttctggacttatagcaattgatgcttttattccttttgatttaaccttctttatatctatttctacatctttacttgcttcaatatgaaatgatatattctggatttagatagctatacatatctatatatttcagtgtgtctacagttgccaagtgtatgtctagaggaatattggtaacactttttatttgttccaatacataaggtcccatagctaaattgttaacaaaaactccatccattacatcgcaatgtaataaatcaacctttgcatcttctaatttttttagttcactatgaagttctaattgattcgcgcacattattgaggctgctatcttcaatacaatcactccaatcaaaaatcatttaaggcatatgaaagaaaataacaagtccaaaatgcccttattatttttttaattgtacttcaaatatattgctaaagttatctaagttcaaatcttcatattttcttaaaaatggcattaatctttctaatattttattaatggagttttcagaatctgattctatatttaatggcagcacaggctcatgcagcgataatcttaacaataaccagccatctccattttctttatcgcaatttatctttattccttcataatttttaggttcaatagtccatccattcacatgatctacatatttcttcaaaccttctattatcatttctccatatgatttaaaatcttccctctttatgtttattctcatatccatactttccttaggatattttaaattttctataaggcttgatatttcttttccttcatcttttaacttggccatcttaattagtattttggctattaaatatgccccgtcatctaaaaagtaattttcttttaaagctgcgtgtcctgatgtttctattgctaaacagcttaactttccttctttatttaatcttttagattcatttattacattcttatagcctcttttaaatctatgatggatgccacctaaactagttataaaatctgaaagtccagtagaggttactgaatctgtaacgataattgaatttggattttcctctagcactattgaagatatcaatgctataagtgcatttttatttatttcttttccatcactactaactatagccgctctgtctacatctgtatcaaaaattattcctaaatcagctttattattaagtactgcttcttttatagaattcatagcttcttcattttctggattaggaatatggttagggaaatttccatccggttctgtaaattgacttccctcaacactcgcacctaatttctctagaactttatatgcaaaaaaaccacctgctccgtttcctgcatctacaattattttggttccctctaaaggtctctcataatttgtttttgaatttacattctttcgtatcttatcaactaatatatttgaataaacatctatgaaatagattgtttcaactagccctttagtagtacatttcttttctgctaagttagaacattcaattatgttttcaatatcttctttttcgcatccaccttctttagtaaaaaacttcaatccattataataatacggaagatgacttgctgttatcattacagctccatcgcatgaataattctctaatatagttgtcataaacattgcaggagtcgtacatattccacaatcataaacattgcaaccagaatcaactaaagcttctattaatgatttcttcaattctggtccagataaccttgaatccatgccaactgctatttttatatttttactactgagtcctttagtttttttaagccactctacaaaaccaaatcccacattattgactaaattaggcgtaagatttttagttccttcatgttctatagctattccccttatatccgttccactttgtagtcttttaagttcttgcagcataataaaccctccccatttttgtccatgcataatttccccgcaaaaaaggatacttctttaattccatatatctataacctagataaaaagataggaaaataagcatattctcctatcttgcttttaaaggaagttacttgctttgtccatagtaagcatttttaccatgttttcttaaaaagtgcttattcataagcatcttgtccataatattgtctggactcaacaattcagtgaaatatgccatcttcgcaacttcttccataactacggcattatgaacagcttcttctgcattttttccccatgcaaatggaccatgatcatttacaactacacctggacagtgtaacggattgtttcctgttatttcttcaattataactgttcctgtttccttttcataagctctacttatttcttccttagtcattttccttgtgcatggtatacttccataaaaataatctgcgtgtgttgttccacaagctggtatagctcttcctatttgcgcccatatagtagcccaagttgaatgtgtatgaacaattccacctatttcatcaaactctttatatagttctaaatgtgttggtgtatctgatgaaggctttaaactaccttcaactacgtttccttctaagtctacaactactaaatcttctaaagtcatattatcatactcaacaccacttggttttattaccactaatccagtacttctatcaatcccactaacatttccccatgtataagttataagtttctttgctggtaattctaaatttgcctttaaaacttgtttctttaattcttctaacattaataatcactctcctaattaatatattatttaaatttttcttctatttcttttatttgattgagtctattaacatgatgcttacctataaactctgtggataaccaaatatctactatcattaaagctaattcttcgccaattactcttccacctaaacaaagtacattagaatcattatgctctctggtagctttcgcagtaaaacaatctccaactaatgctgctcttacaccttttattttgtttgctacaatagacattccaataccagttccacaacaaagtattcccttttcacaatctcctatagataccctatttgctacatccatagctatctgaggataatctatactgtcttctgaaaatgtgccaacatcgatatattctactgagtttttatctaaatatcccttgataaattcttttaatttatatcctccatggtctgcccctattgctatcatgtatttcagctccttcactttataagcttagttaaagtattgcttccctaaatctttttattgttgaatcaatatcctcttctctaaatattgctgatccaactactatattagttgctccattttcaacaactttacctatgttctctaaatttattcctccatcaacctgaagctcacattctatattttcactttttatgaaattactcacttcattaatcttttccatcataggctcaatgaagctttgtcctccaaatcctggttctacagtcattattaatattttatttaccatatgacttatatgtttcaatgtatttattggtgttgccggatttaacgctaccccaacttttatcccaaaactcttaattatatacattaagttatatatatgtggagaagattcttgatgtattgttattgtattcgcaccagcttcaactaacgcatcaatgaatatctctggatttgttaccattaggtgtacatctaattctatatcacaagcaatttgtttaatcatcttaatttgatctattccaaaagcaatattaggtacaaaatgtccatccattatatctatgtgtaattctttaattccctgctttttaagttttactatagtttcttcgagttttaaaaaatttgctcctaatattgaaggtgataatttaacttccatattatatccctgcctttaaattgattttactgtttcaactatatgttctgctgttaaattatatttttctaataaaacttcagcatttcctgatcttccgaactcatcatttataccaattctttttatttttactgggtactcttcaattaaagcctctgcaacagttgaacctaaccctccaattatgctatgttcttctactgttacgattttaccaactctttttgcaacctcaacaattaagctactatcaaatggctttatagttgaaatattaacaaccgttgcattaatgccttgttcacttaatatttgagccgcatccaaagcttttgctaccattattcccgttgcaattatagccacatcatcaccatttcttaatacttcaccttttccaatattaaattcataatcttcagtgtgtatttctggagttgctgctcttcctaatcttatatatactggtccattgtattctttcgctgcaaatattgctttttttgcttcaataacatctgctggacttaatacaaccatattaggaatgcttctcattaaagatatgtcctctattgcttgatgacttccaccatcttcaccaacagttatacctgcatgggttgccactatcttaacatttagtttaggatatgctactgaatttcttatctgctcaaatgctcttcctgctgcaaacatagcaaacgtacttgcaaatggtatttttccacatgtagcaagacctgccgcagttccaatcatatctccttcagatattcccatatcaaaatatctttctggtgcaattttcttaaactcaatgcttttagttgcttttcctaaatctgcttctaatacaacaacattattatctaatgctagctcctttaatgcttgtccatacgcttctcttgttgctactcccattatttttcccctccttctaattcagctagtgccttttcagtttcttctttatttggtgccgatccatgccaattaacgttattttccataaatgaaacacctttgcctttaattgttttacaaattataattgttggtttaccttttgtagcattagcatcatctatggctttacttatatcttcaaaacaatgtccatctatagttacaacattccatccaaatgatttgaacttctcgtcaatcggacttatactcattatttcttcattagatccatctatttgcaatccgtttaaatcaagaaaagcagttaagttatcaagtttatagtgtgcagcactcattgcagcttcccatatttgcccttcttgtgcttctccatctccaagtattgcatagactctgtaagaactttcatctagctttcctgctaaagccattccatttgctgctgatagtccttgtcctagtgagcctgtggacatatctactcctattacctttttcatatcaggatgcccttgcaaatttgattcatattttcttaatcccaaaagctcttctttagggaagtaccctctttctgctaatgtgcaatacaatgctggtgctgaatgcccctttgataatacaaatctatctctatttgggtctttgggatttttaggatcaatattcatcttttcaaaatataaaacagttaaaatatctgcaattgataatgatccacctggatgacctgattttgctgctgatacacttttaattatgttcattctaatgctattagatattttctttaaattttctttcataactattcaccacctatatttctactactactttattgaaattaatttctctatttaccatcttctttaaatattctccaacctcttcaagttttatcttatgggaaatcataggtttaaatacaatctctccttttcccataaagtcaacggttgcatgccaagcattccctggatatggctgtgtgtaagaattccaagatccctgaatttttaattctcctcttaatatactttctgttgctgattcacttaatggtagtggtgtatgagatattcctacaaataccacatttcctttctttttagaaataagtaaagcttgttcttgagtaaatttgcttcctgctgtctctattaccgcatcagctccaccacttgtaatctttttaatttcggccacgacatcagattcctttgaattgactgaataattagctcctaactttttagcaagctccaatttttcattaaaaatatctactgctataattttagatgctccgaaaaccttagcccattgtatagcaaattgacctattggcccacatcctaaaactactacactgtcaccaaccttaatacctgcttttgctagtccatggtatgctatagttgctggttcgattccggcagcagtttcaaaatctaaactatctggtaattttaatatatgatccgctggcactttgacatattcagctaaagctccatttactcttgttccaataatgtgataatcagtacataatccatagtctccagatttacagtaaatgcattttccgcaaggaactaaaggtgcgactgcaactctatctcctatttgaatattttttacatccgatcctaccccacttatttcacctgaaaactcatgacctaatataatcggatattttgctcctccactaagtccacttaccatacttcttggtagatctgaaccacatatacctacatttttaacttttactagcacttcattagatgaaatttttggtatatctacaatttcatatctaacatctcctattccatacaataatgaagctttcattttatttgtcactataaacatcccctttctatctttctgaaaatatataaagcaatttccgtgccatacaaaaaagtaattttaatttctttatatgccttatatttaaagtgttaaattcatttatattacattttataaaactcattacattatgataaattgtaaaatcatatggttttattgtgacctatctttattaaagcgaataagatttcttttctattcttttttaaatataaaaactattcaatcaaacttctttaagttataccctcaaggagtacatcttccatagattttactgaaatataaattcctaaagaataaaaaagtatcctgatcagtagatcaactattactatctactaaacagaatacctttcacttaatttatttttctatattaacttgccatgctcggagttgccccatcttcccctatattcttcacagcttgtctttctaaatagtcaacaattgcatttttattcttcttaaacaatgcccataaagcaatatatactgccaccgcaattgcaataaacactggatttcctgttaagaatgcaaaaaatactaatcccattaaaggttttcctagtatattaaagcttgtaatcatcatagcacctgctggtatagctacacctacaccaactgccatcgatgtgaacaatggcgctgtaaatgtgcatacatataaccctaatccgaaccatattatgcctgaaagtaaaactttaaatatatttccgttatatacagccactaaaccttgaaccatatatggaagtgcaagtaaatcaactacaggtaatacttgatttcctggaagtatcattgctaatacaagcataaatggtattaatattaaccctgatatcaatgttgctggttcaccatatcctactgcatcgtttactgctataaaccaatcacgatttccttggttttgcatgaatttccttgctccatctgttataggtgaaaatgcttgtgcaaacatactagcaactttagggaaaatagccatgactgcactagttgcaatgcctaattttaatatttctccccatgcctccatagttcctattcttgccacattacctaatatacctataaacattcctaaaaataatcctagcgtcataggttcaccaaagaatcctagtttcttttctaattgttgtggattcagtttaatcttattaaatcctaatgcgttatatattggatctatagcaactgcaaatattgatgcttctacattatgcatagctattattgtacaattcggatatctgtaataatttgaccatcttcttgctactaattctgatattagtaagctgtataaatttaacaaaaccatacatgctattcctaaagggaagcttcctgttacccctataaccatagctccccaaaccatgtatgagtaattattccacaaatctgatggttgaaaaacatctgtccactttattagaaataatacagtctgcaatagaattcctaatccaagatatatcatacctgcacttgaagagaaagcaactagcgatgtagcttgccatcctacgtcaaacactggacggtttactcctgtactttcaaccattctattaataactggtgttactattggtgtaaatgaattcaatattagtgaaaagccctgcaaggcaacaccagcatatatagccgaaagaaatgatttattagttgatattctgaaaacttttgctattacaaatataataaacggaactattattgctgatccaaatgtgtcaattattgatttaagaaatgctaacatatttaattcccccattattaataatattttactatttatttagttcgtctactgttttgaatacgtcttcaaaaaacttatcttctcctattcctgtaagacatgcaaatgcattgatagttggtatcttataatccccaggtggtagtggacttgtgtaaacaataaaatcaaaccttcctgactgtgctaaatttaatgcttctgttggtcttgcttctgttgtagaagagcttattcctttttcctttaatgtttctttaacttttcctgcgaccatagacgatgttactgtacctgagccacaaactgataatacgttgacatttttcataatatattcctcccaaaaatttattatataaacttaaaatcttttataatttcaagtactatattcctatacattctaataattttgttacttcctctgtagatgatgaactctttatctgctttaataactccacattttgaaaaactgacattagtttgcttagcaaagttacctgagaatcaggatcgtttatagctaataaaaatacaaccattacttcaactcttttgctaggatctatcatatttctaaactctactggattctttagaacagctagtgctacattagattcatttacatgcttagaatctgtatgcgggattgctacacacatttctccgatatcaagtcctgtaggcagcgtcttttctctttctagaacagcatctatgtaagtagacttaacataccccttttcaaacattctctttcctaattcctgtatgacctcttctttgttttttacttctaaatttaatgcaattaaatctgaattcattgttattcccctatttgttatatttctttaaacttgtttaaaattatatttttaaattccaactcagttaaactattcttcatattttctatgaaaatcttatcctctaaaatttttagtgtgttttttacaattaccttatcatttgctttaaaaactggcataaatattatatttacatttccaacccccaatcaattggactttttaacttgataaatacaaagcttgtcttgtttacgtatgaagactctccatgtggaacagctatttctccctttagatatgttggagctaaattttccctattaacaacagatgataaatactctttatctacacttccattatttataagtattgagcaaacatactccaataaatcctttttgaaatatatatctggttcaaatatcaataaatcttcatctataatcctttcatatttttttagttcttcacttttatttactaatgaatctatatttaaattatttaagatttctttatcatacggtatgaaatttattccctgtatttctggatccatagttcctatgaccgctaatatattattatcttcttttaatttaactatcttgtttgataattcttcatctagtgcactcatttcatagaagtttacatcactatatttatccattaaattcttacttatatatttagccattccctcacccgttagacataatgaaattattgcttttggtttatctgatacactttccataaaatatctatgtccgagtctatccttcattaaagaaaagtatatttcatcaagattcccttctcctattgaaatctttctagctgcttctaatgcgattataaggtctaccctatccattgtccttgattttattccagttcttttattaactatatctcctatattatttaatgaacccatatctactaagaagagcacgccttttccctgatctattatttttgatagttcaactaccttgttatatatattgattggattctcatctaaaggcatgtctattgctacaggaaatcttattcctaaaagttccttaactacattagttatagcagtagctatttttccatgagaaattatcattaatccaactttatctcttttattttcagattttagtgctgcttttatatacagtcctataaatataatttcatcattaggtatttctatgtcttttattttttcaactcccatagcaaatcttttagctacttcatattcataagttgtatcgcttataattttatctacatttattatcttttgttttaaccttatccttttaatgctttcctctacatggatagctaagtatttaaatacatttttatttatttctaatgatggattctctttaattagttcttccataaaagtttctataaaatctaataaatcttcacttacaaagcttcttaaatcattcatagaaaatgatttttcataattaaaagtagtttctatatttgtaaaactattttgtataaatgcccagagaatactttcaatatctgcttcttgtatatctatcttcttaagttcgtaatattttctttcaatctgcctatatatatcctctggaaatgcgctttcactaacttctgttgattcttctcttaattgattttccaacataaatggaataaatatagaatcctttacatattttcgtatctctgctctattaatatcctgaaattttatatcttgaaacgagtcatttatctttaatatttgattcatatctattatcaatgattctttatttatatcttccttatttatgaaagtcataaaagctcttgcgcataaaacctgaatcatattctgcaattgaccaatattagcactaaacttttttagagcgagtatttctactacttttttatcaacaaaaattttagcatctattctattacattctgcttgaaattcattatagatgatatcaatcttctctcttattgatctttcatgcagagaaggaatttttattaccattggtatccttcttctaaatgttaatagtaaattagcttctacattttcagtagttgctccaatcaacattaaattaacttttctttctgaattggcttcacccaatcttctaaattttcctctatccataatagagaagagtatttcttgaccttttggaggtaacctatgaatctcgtctaaaaaaagtactcctccatttgcttcttctactaatccagatgcatccgaatctgcgcctgtaaatgcaccttttttatgtccaaataagagtgataataataattgtggattatcaccataatcagcacaattgaatacaacaaacgaagcgttttcttttataaccttctttttctttgcaaattcatacatgcattcagaaaatttacttttaccaactccactttctccgactattaatgttgtaagtcctctaggcggatataaaattgctgatttagcttgttctatagaatttttcaaacttccattacttccaattaggcaatcaaaaggatctgttacttcctctttttcaactttaactttattaacttcaaaattatctttttctaatatttcttcaacaattcttcttgaaacatcaaatccttcggccaatagttctctagtaagctcagatactgcaatgtctttatttttttttaatatagttgatgttgccacctttaaatatggatatctcctttgcctagagtttgctatgtttaattcttttcttaaattggttattgattctctagccacacccaagaatttagccatttgaacatcagttagtggattttttttattttcggtattaatgatgtttataagtttgttttctaaatccataataatatctcctctcgcaaattaaatatagcaacttccatgccatacttaattcttttttgtaattttatcctaagcattgtatttactagcatttattaaaccctttacattttaatcaaatatacattttgtatagtaagtaattaacaaaatgtatatttagaattaatgatatagaagttattataattttactataatatcacttaactatataattttgatctaatgttaacttgaaaattgaattttatagtatataattggtattataatttagttgcatagggggtattcaatttgaaaacatttactaccgaatctataattaatcattcttgtaagaaaatatttaatacttttgtaaaatctgcaaaggcaaactttcctgactttaaagaaaaaagagctgttggaacctattctaagcaaaagaagaataaaagatttagggttgaaataactgcatttgaaagagataaaatctacgaaataactgctagaaatagaagagaatcctttataactagatatcaacttattcctatttctgaaaatgagactaaactcatttttactgagatagaaagtgatagaaacatatttggaaaaataaattctgcattaacttctttacttttaggtaaacgtcaacctgatgaatttaatacttttataaagaacttagaaaaatcattagcttcctaatcaacatattttaatctttcatatagaaagcattgtcattaataaattatctctaataaaaactactttagcttttaatgacaaagctttttacaattcatgtattctctacttttatactaagtgaattagtaataaaaaactttattaagctgcaatatctatttacaaattataagtcttcccaaaatacacataaaaataagataggactagttttataacatagcctatctcgaaaaacttctgatattgtaatatctgatttacatctttatttactaatctcatctccagtttttacttagaaattacttttctatacattatagatataaatttattgtcatttttacttattcatgtatctgaattactatatctcttctattgctaacagtctagggttactcccctcttgtattttaatatatacttttgccatcttcatttgtaaatcttttattactgtttttactctacatataaaataataatcttcaattccatttgtaattactgcaaccggattaaacttccatccctttattccatctagtgcttttctaagcatttgtttgtcttctattgtaattttatctttaatttttaattcttcaatttctcttaacataaatatcaaactcccttccttatgaatatactattattttttcttgtcagttctttgtcaaatatattaatcatttcttaatatattgttaaaagaaaataactaataaattaatagtattaaacgatataaatttgtcccaataaactcaaaatattaggcagcatgtaaactaatttaaccgaaaaaaactagtatgctctatactagttttttcaaatcttttgcattacataataaaaaatcacactcttatttataaacaatgtgatacgttagcgtgatatttaccttaaatatgtacattgggaaatcagttttccaaaactcttctgactgattgtattaatctttcatttctaaatggtttaacaatgaaatctttggctccagtttttatcgctttgataacgatatctccttgtcccattgcagaacatataatcaccttcgcattaggattaatctccataattgatgatagtgcactaattccatccattacaggcattgtaatatccattagtattaaatcaggatttaattgcttatatttttcaatcaacacttctccattttctgcctcgtcaactacttgatatccctctttttctaaggaattctttaaagtaactctcataaatctagcatcatcacaaattaaaattttgtcattcatttcattttcctcctattcatttcaaataggcaaagacttgcaactggctgccatcctttcaaaaggaaaaggccctctagctttgcgtcacagtttttcaactgctttgccaattcaatattaaatttaacattaaatatatcgtacttttaaataaaaactttattttgcttatctaacgtttattgttaatgtagtattgttaaacttccatagattattatcctaattagcatctatctactttttatacaatcattatcattacatttcactaagttttaaacttttcataataattattttccttaatatgcttagcaataagctatattttttactccttaattgaagcgcgaagaattatttattactatttagaattatttgaagccaaccttaatataattaaaagaaacctcttgaatgttatttgtttctcatttagttactctccattcatagtctttttttgttctaacctattcactaggcccttaactttaggggctctttttatttcaagataaattaattcctatttatcttaaaaatatgttaaaaaataaatcttctgactatataaacccacagtcagaagatttttaactaattatattcagaaaagtccctttagtgcttaataaagcatactttcataaccactatctgaattctaaatccaccattccgctcatcttcgcttaggctaaaaagttatgtttaatttaacttatctgtttattcatagagatttctagtaaactttttcgtctaattccaagccataaagcaattcctattagacatgagagtccttctgtagctgtcatagcccaaataacaccattaacagtaaatagtaagtttcctacaatcagaatagggacaaataaaacacccctcacagcggccataatatttgatttcacaccatcaccttgagcttgaaaaattccagtaaaaaattcacatagggcagcaaaaacagttgaggaaagttgagctataagggttatttgaccaatggcaataacattaggatcaatactgaagatgccaataatctgtaacctgagtgcaaatagaactgctcctaaagttaatgttaaaccaagcatatacaatatagttttcttaacaatttccatgagacgcttttggttatttgcagagtaagcaaatgcaattagtggtacaactcccattgcaaagcccataccaatacaatctacaatttggacaactctttgtgcaattccaaatcccgccacaacactatctccataaatcatagaataattattgaatagcaggcttatgataacaaaaaatccactcattaataaagctgaaactccaaccttaaaaatctcaccataaatttctttacttggtttaaagtccttaattgacaagctctgaacagtactcttcttttgcaaataatatataaaatacaaaacggaaactatattaccacaaacagaggctagtgctgatcccataacattcatatttagaacgaaaatgaaaaagggattaagtattatattaataataatacctgctatggtaccagtcatagaaatagtggatgcaccctctgcacgtacagatgcgtcaagcgccatattaacaatgataattggagctccaataacaagtaccataataaaatttcttgtatattgtaacgtttcgccacttgctcctaaaagcggcaaaatagaggataaaaaaggcagacatatcatcataagaataatacccataagcattgatgaccaaaagttaatagaactaacttttcgggtattgtctgtattgccttcacctaaaagtcttgatatatatgttccagaacctactccaaacatttgtccaattgccattaatactaatgaaaatggtaatgccagtatcactgccgccatcattgcagtattattaagtttaccaacaaaaaaagcatcgatgatattatatacaactgatgcgatactacttagtatcataggagtagccatgtgtattattgcttttgtaacaggtgccttttcaagatagtagagtgatttttcatctatattttctgtgttttccatataaaaaactcctttcgcattgtatttaagtaataaaatttgccttaacaataatattatttctaaagcccgtttggcttctacaaaacatagtatatgtctgcaatttaaactaaacttaaatggaacttaaactcaatgtaaacaaaaaattacagtctgttaattcagactgtaataatgaacatatttagcttctatttgcgcattatcaaaaaaataacaagtcaatctgcctgaatattaggacttgttattttctttcatataccttaggcagccaaataataaattctgtaccttttccaatttcacttgtaagagatattttccctccatgtaagtcaataatcttttttactattgaaagtccaagtccgtttccacccaaagaacgattacgagctttatctgctttataaaacctctcgaaaatccgcggttgatcttccgatgaaatacctatacctgtatcggagactttacattcgaccccgtcttcattgttatataagttaacacctatatttccgttttctggcgtaaatttaatagcattattaagcaaatttataaatacctgacttaataaatcttcatccccacatatgatagtttcttcaagagaaatatcaagtgttatattttttgccgaccactgtggttctaacataagtaaaacactttcaatttgcttgtttatttcatatttctttaagtttaaattattgtcttctgattccaaattagataatcttaatagattttcgcttaatttagataatcgtttactttcagtttctattatgctggcataatgtgatatctgatccttatctaaacttcctttttttaacagagtagcaaaccctgatatagaagttaatggtgactgtatttcatgtgacacatctgatataaaatcttggcgtagtttctccaaagaccctagctcctttgccattctgttgacattgtctgctacctcattaaaaggatcgagttcatttgttttaacaagtacattgaaatcaccagaagctatcttgttcatggcttcaacagctccgcttaatattggaaaatgtgaaagatcaaattttttatgtttattagcgaagcgccagtgcatatatataaatgctttccaacctagaaaatatatcacagcagaagttaagctttgaacaataaatattatatgtagaggaatgctttctgacttaccgaaaataaatatacaaatgtaatatccactagtaagaccaagtaatgttataataaaaattagtattagtgaaaaaaaatacctgtttccttccctcacttcacttcctccactctgtaaccaagacccctaatagtagtaattttgaacttgtaaatatcagactgaaacctctctctaagacgatttatatgaacgtcaagtgttcgttcatttccttcaaaatcaagaccccaaacctcttctatgagcctgtcacgggaaagggttttacccggataacttccaagcatgaataagagttcaaattccttcataggtatatcgaattgttcattattactaatgactgtataactacttttatccatcactaaattaccaatattaataatccgcgaagcagctactttataacgcctcaaaagagcttttattctaacaagcaactcatcaatctcaaatggttttgttaagtaatcatctgtgccaagttcaaatccctttactttttgagaaagttcgcttttggcagtcagcattaaaattggcatatcctcataatatctgcgtgcttgtttacaaaattcatagccatccatttgaggcatcataatatcaagtacacaaagatcaattttttcctccccaagtttttctaatgcatcccttccatttacagcctcagctaccgaaaatccttcatcttttaatactgtacaaataagctctcttatataatcatcatcatctataactaaaatcttattcaaatctatcaccttcctcttttgagtatagaatatcaatgtaaatacaatataaattgatttgttttttccctcttcattattatcataacataaaaactttttatgattaattattgctttcccttttgaatctaagatatttatattttctttttcaaaaataacaccaatgccagttctttaagcgttattacagaattcaaagtatcaagagtacttttgcttatagacttgatttttatcatatctatctttcctgctttgcaatcctctatcatcttattgaactgctctctatctttaaacattaaatactcacaacaaatatttaaacttaacttttattcaatatttataaatatacttatttctgcgtaaaaatttctcccctaacccaaaaaattccccaaataaccttggggaacattaagagattttttagctcttataaatccttatcctatgaatataaaatacactccaatattaacttaaaacccttaattgatattaatctatttcttaactatattcgcagctgtttcaacctgtgttttggtagaaagatgatactaaaacgcataaaaatgctatttatttagcaataacactaatagccttttcaacaacattttctacagtcaatccaaatttctcgaataggatttctgctttacctgacgctccaaaagtatctaaagatataacatctccatcaagacctacatatttgtgccatccaaagcttgttaatgcttctactgcaactctagcacgaactttatttggcataactgatcctttatagctttcgtcttgaacatcaaataattcaaatgatggcatactgataactcttgcatctatacctttagcttctaattcagctgctgctttatagattaattctacttctgaacctgatgccattaaaagtacatctggagtttctttcttagaatcttttaagatatatccaccctttaatgctctcttaggacatccatcatatagtggtaacttttgtcttgttaatactaatgatgttggagtagttccattagttacagcatagtaccaagctgctgcagtttcttttgaatctgctggtctaaatactgtcatatttggcatacttctaagagctgctaattgttctattggttcatgagttggcccgtcttcccctactccaatactatcatgtgttaatacataagctactggaagattcataagagctgataatctcatagcacccttcatgtaatcgctgaatacaaagaatgttgcacagaatactttaagtcctccatgagcatacattccgttagcgatagctgccatagcatgttctctaactccaaagtgaaggtttgatccacttctatcttctgctgagaaatctcctctatcgttcatatgagttttgttagatggagctaaatctgctgatcctccaataaagtttggaattagtttagctaatctatttatcattattcctgaagattctcttgtagccatttctttatcaaagctccaaagttcttcattgtttaataaagcttctttatcaatttctccactcatccatttagtatattctgctgcaagttctggataagcttttgcatatgctttgaacaactcattccaagcttcttcagtcttctcaccttttgctatgtgttcattcatatttgtgtacacttcgtctggtacgtagaatgctagctcagtcttccatcctaagttttccttcatagcaattacattgtctgctcctaaaggttcaccatgtgctgaagcttttccttgttttgctgggcatccaaaaccaatttgatttttaactgttataatagatggttttgttgtttctgctttagctgcttctattgctttttctattgcatctatatcatttccatctgctacatttagtacttgccatccataagcttcgtatctcttagctacatcttctctaaatgctatgtctgtatttccttcaattgaaatattatttgaatcatataatacaactaattttccaagacctaaagttccagcaagagatgatgcttctcctgagataccttccataaggcatccgtctccaactatagcatatgtatagtgatcaactacgctataatctggtttattgaatttttctgcaagatgtgcttctgctatagcaaaacctactgcattacaaataccttgtccaagtggtcctgttgttatttcaacaccttttgtatggccatactctggatgtcccggtgtcaaacttccaaattgcctaaagtttttaatatcttcaactgtaagtccatatccaaataaatgtagcaatgaatattcaagcattgaaccatgtcctgctgataatacaaatctatctctgttatcccattcagggttctttccattatgattcatctttgcccataatgtataagccattgtagccgatccaagtggtaaccctggatgtcctgattttgatttttcaatagcatctgctgataatactcttattgcgttaatagataatttatctaattctctactcatctttatcctcatttcatagacatatttttttataagttcttagttgtgctaattaagtcccatgctgcgcttcgaattcatttcaaacctgaaataatcttagctatccttcattatcttttcaaaagatgcctattttaccacacctttttatattgtcaccttttttctccgttactttttaagttcttttatattttcatttataaattcttatattcttttattcgtaacttcttacattcttatattcttaagaatatatatttttatcatttgaaatataaccccagaccagaaatgattgtcatgcttttgtggaagcgttatatcagatgatttagttgtagacatttcttcagtagaagttgttctatttatgcatgtccttagtttatcttaggaacatgcataaatagtgcaactcctgctgttagaaattcacggctaaccctatttcatttatttctttaatgtgttttgcgtttgctgtgtctaaaaaagtttgtaatgaatttagacttatagttttgttttatatgattaatatacagatcattctttatactatatattttcaaagtatcatattattctaaagaatgaattatttatcttatcagtatcttttttcttttaactttttagttataggtagctaaattcttttatctatgagctaataaagaccttctttcttcataattatttaatttacaataattattttttattattataattaagcatccatcgtctattcctgtgaaatgccttattgattcttcaataccattttctttaatatattgttgtaagataacagattcttcatcttcaggattatcaaataataatgctcccgcaactaacattgccatatatttaactggatattctttctcatataattttaaagttggtcccacaagtctttcattcattcctaattttctaactggagacctacctacacgtagaatatcatcacttatatttttattcttaaaacgtaataaaattttttccataaaaatatttatttcctccaaagaaatatcatattctttaataaaatattgtgctgtttcattaagtgcaccttttacaatagattcaatcacatgacttttcaaagtatcttgaatagttttttctccatttaaaaatccaagataagctgtagctgcatgtgccatatttacgcagtacaactttctttcaatatatggagttagattagcaacatacgttactccttttatatatggtaagttattattaaccatctctgattcattaataacccattcatatataggttctactaacgcaacctcatcttcttcgttttcttttgataaagcaagtctatctattgcagaattaggaaagccaacatattcacatattttatttatttcttcattagaaaggtatttttctacttccttctttaaagttgatgatgcattaattgcattttcatttgcaataatatttattttagttttattgattttaatacgttttaaaagtcctttagcaatacattcagcaatacgtggaatatttcctattccaacagaggtagtaataatatctgctttaacaattgaatttaatacttcttctttttgagtaatgctattcaatgcagatacaggactgataacttcaacagtatgatcatcatctaataattcaaccagatatctcttatttctattgattttatctatggcactttgattaacatcgacaaagcaaacatcaaaccctgctttatttaataaatacccaataaaaccttttcctatatttccagcaccaaaatgtaatgcacgcatataaattatctcctttgattttattctagattagcatgatattgccatagacttggcatatctatatttttttctttgatcatcattaaggcaatcgtatctcctagaagtagaagactttgttcaaataagcttgtcataggctgaattgaaggtacttcattaggtaaatttaattttgtgctgactggaattctaacaaagtaatcagcaaattccttcatggagctgtttggatttgctccaatatgaataactgttgcattatgctgctttgccttccttgcaatagctaaaggaaaagctgtttctccgcttcctgaacctacaattaataagcctttttctgtaatagcaggttctgtgatttgacctaccacaacgctgttaatccctaaatgtgctagacgctttgcaacagcttctaaggataataacactcttcctacaccaacaaaaaatactttatctgctttttgaatctgctcaaataattgctctacttcagcatcacttatttttactaatgtttcttctaattctttaataatttcctttgagatatcagtaaattcaaccattttatatcacctctctacctttcaatccttctaatatgcttttttccattaaagctttattttcagcaatgctttgatttggaataaataagcttgtgctaccagctaccaacatatctgctccagctttaactaagcctggaattgtatctaaagaaacgcgtccatctacttcaatttttgtatttaatccatttcctttaataagtttatataaatcttttaccttcttttcagcatatatcacttgcttttcatttttgtcagttgcaaagcctggattaattaacattagcattatcgtgtcacactgaggcagacagtactctaaaacactaagggaagttgatggattgagtgccaatccagctttaattccattctttttaattagatttatatatctgtcaatgtgtgtgctgctttcataatgaaaagatatttgtgaaactccgatttttatcatctcttgaataaaaaattcattgttattagacatgatgtgtacatcaaaattcatatctgtgatttttcttaaacttttaactgtatctatacctaaaggcatacttggactaaaatacccatcaattaaatcaatatgaattgtatcaataccttctttttcaatttcccttatgcttttttctaagttgcataaatctgcacacattactgatggtgaaattattatatcatttatattcattttttacctccacttactaattatgtaattcaaaaaatacaaaaggggactgccatttaagaaacctaaccacaataggttgatttaaaattcaaacatctaatacaacacattgtaatttttattctttatgtaacagcccctttcttttaaaatttgctttaaagattattaagtaagaacttctctgcctcttcgcaccagacattgttgttatttttacatatttcagatagcttactataaaattcgttattttcacctagcttttcaaagtcttcaattgctgtaagttccatttctatatgagaataaattaatttcttacctcctggaatattaggtaaattttttatagtatctggagctgcatttaatcctccgacatgggttatcataaaggaaggattaatcagccctttttcagacaattctatagactcaagcatatccccttttgacccacctgaagttcctactatatgagtgccttcatagtgaactttatagaaattaaattgtgctttaaagttattatctgttggtcctgcaaagaaatttaaacatccgtcattacctaggatatcatcagcagcttctattaactgctttgcagctgcaaatacaaatacatcatcatatcctttgccgcctgacaacttcataagctcacttactgtgtccatatttttagtatttaagtatattaactcaatacctttttctttagcttcctcaactttaattaagctggctgctctatttaatttggtttcatcaatatctacaactactaccattttaggttttattgctccattaattgcatattctatagcgcctaagcccattggtcctgcacagccaaggagagcaacatttccgccttcttttattcccatgtcatgtgtatatacgtattgttttgtatggtaatttgcatgaaatgctcctataatacatgacattggctctgataaagatgcattggcaaagtaagttccatttaggggaagtacacagcctaaatcaattgctactttaggaattatgcaataggtagcatttccgccaaaaaactcataactatatcctggcgaatatcctgattcaagccccattgcaggctgtagcacaaatctctgcccttctttatatttatcttttaaattattccctactttttctataattccagcgaattcatgacccgtaattgctggatgttctgaaacatcttctggaactcttttgtgttcttcacctctaattagcgctttgtatgtggataagcagacagtatctgagatcacttttactaataattcattgtctgtaatttctggtaattcaaattctcttatatatattttatttttcccagctataacagctgctcttgctttcattagtcaacgtctccttactatctataattttgctttttgctcaaccaactcttctaataattcttctatattaacatccttcatgaaattttcaatggttactatacgtttttctggccatgcagcactagttctgccgagtaggttcttatgcgttacaatgacatctgcttcttgtggaactttttcaatagcatagtttttaactgtcacttcaagaccttctttttctactctttttctaaatgcacttgctcccatagcactgcttccaagaccagcatcacaagcaaaagctacaaattggattggttttattaaagcagcatttaatatttgttttccttggcttttcatttctttagatttcttaaccgattcttcaaaatcatcatcttcttgtttagaagtttttaatatgaaagatgctactaaaaaacttacaagtgttgccataaacactccagcgattactccagtaaaattaccttttggtgttaatgccatgtatgcaaatattgatcctgggcttggtcctgcaactaaacctactttgaataaactaaatgttgctatacctgtagcactaccagccatcattgctaggattaatattggtttcattaatacatatgggaagtatatttcatgtattccacctaagaaatgtatgattattgcacctggagctgttttctttgaagttccttttccaaataatgagtatgcaagtaataatccgagtcctgctcctgggtttgaagcaaccatgaagtaaatagattttccagcagctaacgtagcctgcattcctaatgggtagtaaattccttggtcaattacgttatttaagaacaatacctttgcaggttcattaataattgctaaaattggtaaaattcctgtgtttattaagccttgtatagctacagttatcgctgcatttgcttcaagtattactggacctattacagaataagataaaagtgtaagaattagtcctagtattcctaatgagaagttattaataaccatttcaaatccagttggtatcttatcctcaataagagcatcaaatttctttataagatatgcacttaatggtcccataatcattgctccaagaaacattggtatgtttccacctactattagtccaaaagtaccaataacacctgcaactcctcctcttaattcataaacaagcttaccacctgtatatgcaagtaataaaggaagcatataagttatcataggggatactaattttccaaagtaatcatttggcatccaccctgttggtataaagagtgctgttataaatccccatgcaataaatgctcccatattaggaataaccattgctgttaaaaatccaccaaaggcttgcactttcgctctcatgcttgtactttccaatgacactcctccttgatctttttcttgtaatcgtttgctagtatccattaaaaatccccctattgttatattttccatcgtttgatagttctagaactaaatcagcctttaaactgttattcagtactctttttacatttttactatcgcttttttcataaaattttattgctgcttccttggacccccccctttctcttcctttcaattaacctctctttaagcatctcctcctcagcttttataaaaatgctataatcacaatgctcctttaaatccctccatccatattcatctaaaagaagccagttaccctcaatgagcacaatatttttagtaactagaattttatcttctactacatcatgtaaatttctatcataaattggccacttaacattttcatttttcagctttactattttggactttaatttatctaaatcaaaggtctcaggacatcctttgacttctgccataggcacttcttttccatcaattattactttattgtttttaataaactcttgattataatgaaaaccatcaagcccaattgcctgtatttcctgagtgccagcttcatttttagagataaactctaaaaatgaagctaaagtacttttgccaactccaggtgaagctgctaagtaaaccaaaattcttctgtttttatctttttctaaatttgtcaattgttttaaaagtggtataaatatattttctatatctttttcataataatctgcatttacctcaaaggagttaactaagaatttgtatgatttaattttatttaacatatacactcaagtacctcttcctcggattttgctgaaaacatcttttctaaagattcatcatccatgagcaagttagttaactcagatattaatgataaatgcgtattgggatccgttgtagctaaaacaaaaattaagctaacctctttttcttctggaaacattacatttttagataatttcaaaagggacattccagtttttaacacaccatcttctggtcttgaatgaggcatagcgatacctggcataataactatatatggtccattctttactacattttcaagcattgcacttatatattcttcttttataaagcctccatctttaagagtagtagatgcaattttaattgcttcctcccaagacgatacttcatctattacttttatattgtttcttaacatatcttttaacataactttatctccttctacttataagctttttacttgctccaaaagatattctttcaatattttttctatataactttgtataatttcctttttaccgcttttaatatcatttaaaaacaaatcatcatcaaatagagcactgcttatacttgaaattgccaatatccctctcggatcatcttcgggtattaacataactacaattacctttgaattagaaaaatattcatcatcaaattgagctgagtcaggttttattagaataaattttgaggcctctactccttttgtccttgcgtgtaataatacaaattcaaattcttttatgacctgagtagatacttgttctcttttcatcaaatcgttatatatataatttttactttcttcattcccacctattgtttcacttacaaatttcatagcctcatcaattgtaatttctgaacttaatgtgtataagtcaaaatttttaataatagagcctatttctttagtaattaaacctatttcttctatataggtaagtgtatcttccttttcctcagtattactagttctactatttagagatgctttttctatttcatttgaaataagtaaaacatcttcttctgtaagcattggatttaccttaatataattaaattgtgagtcattaaggtcaaaagtagatactaaaacctcaaagtcatgtatcttatcagaggataaatcattaaaggaaagagtttttacccttacttcatccttgaaaaatttcgaaatttcagaagataataaagcagatattcctattccactagaacagataactcctacatctattttcctactgaatttataattattctgcagtcttatttcagctccgccaaaatgtattgcaagcagtcctaattcctgcgctggaactttaagattatatttagattcaattacctttacagccctttcagctttttcatatatttgcggatataagcgttttatttcattttgaaacgggttttgaatctcaattccatgctgcaagcgtataattgttggtcttatatgagctatgagtcctcttataaattctgtatcctgctttatttgataagctaaagtactgtcatattcctgaatcatatcatatacaacatacctaatatcggactctgtatcaaaaatatcctcattttcgttaatgtgctgcaatttagcacctttaatgtaaatatataaatctatgatttctgtagttgtatattcaattaaaaactgttcactaagcagggtaactaactctattacaaattcataatccttaatgctttgtaacgttaaattaatatttttttcctttgtatttttccttccttctataattcgttttgttgttatagataaatatgctataagctctgtgtacgaactttcagccacctcgcttaatctgttatccctaaccttttttattgaatcgattactttgtttacaatattagcttctaccaagttagataatctattaagcggatcttcagttttttgataaatatatctcatacatacttttctataatcttcttcttcgtattctaaataaatcccaaggccagattttctaattaaagttacattacttttcataaaccactcttccacaggatctaaatcattattgattgttgcttcactaacctttaaaagacttgaataataatatatcttttgcggttcttcctgctttaatagttcaagaatgatccgattatgacgttcttctttgttcttcggactactatattctaaattgtttaactcatttaatactatgtttttgttagctttacttccaataatgcttattccttttttagatttggtttctaacttaaggctataatcctttaaataattatctgcattttctaactctctgaatattgttctcttacttatctgcaaattttcagccagacttcctgctggaataggcttatatgaattgagcaaaagaaataaaatttgaattaatcttgctgagagcatcatatcgtcccccttcctgatttattatatgatgtaatcggtctatttctcaactaaaagaaaattattattgtctttattttatgctgacaagtttgaatttttagagtgtttacctattgaaaatagaatttaaatcctttttaaataaggggatagatatacattaattatacattcctgaattttcatgccttcaatattactttcttacaacatttgaataacttagctaaagtactcttttatctaaatgtacaagctcataatattaattctagtgtataatgtagtttgattaaatttcacctacatcttttatcaaatattttaaagctataaatttttcattatgaattatttctatttattttttgcagtatataatataataacttgttttacttcattttttttattagcacaatcttgtcattattgtataatgacaatcttaaggaatatcttaaattcaactttttattataattttttatatagaataataagaaaaatttttaatttattttacacttattactcatagtgaagattagaacgagaaaatatatgattaattcattattacaccggaaaagattatacaaaaattactaataaggcacaatgctaggcttaatgaggagtactgttcgtattattggttggatatcaggaagtagatataaattaagtgtaggcatcgtcatattaaaaagttccaacataacaatacctaaatatttgataattaatgttaactaatctcaaaatctttcttgttgaattgattcatataatcctttcttccttcttctcttaaacctatttcttggtatgaaaaaaagagccaagattttgatctcagctctgggattttgtttgaattttgggttagatagaattccgaccaggatggcggtttcgttatggtttaataataatcgcctgggattggtaggaattgagatggtttatggtttgcttacaattccttagttagcctaaccacagtttcagcgtgaggcgtattaggaaacatatccttcaccttagttttaataactttatatcccttttccgtaagtactctaagatcattaactaatgtctttggattgcaggaaacgtatattatctctggtgcattaaatttaattacataatctaacgccttaggatgtactccagttcttggtggatctaatattattatatccggtttaacttttactgtttttattatttctgctacatcaccagctataaattcacaattatttaatccatttaatttagcattttctcttgctgcttcaactgcttcttcaataagttctattcctattactttctttgcatttggagctactatttgccctattgttcctgtaccacaatagagatcaaatacaattttttcttcactatctcccataaactctttaacaatagaatataggctttctgcaccttttgtattggtttgaaagaatgaaaatggagaaatattaaattgtaattctagtaatgtttctctaatataatcttttccaaataacacatttaccttttctggtattactgcatctgatttcgaattattttcagtatggattatagatactaaatttcctttataactttgatctcttagcaatttaacatattcacctaaatcaaagtctatctgagtagtagtaactaaattaactaatatctcaccagtattttgagcttttcttatcactaagtgccttaaatagccttcagctttcattattctataataaggcaaatctttctctctaaagtaatcagcagtcaatctaataatttttctataatcctcatcaacaagtttacattcatctacagttaatattccaaaggattttcctctcatatgcatacctagtgaaagtggctctcccttggcttcatcaccaaatgtaaattccatcttatttctatattcccattggttagggcttccttgaatgcctaaatactctcctgtgtcaacatttgcttctctaaataattctttaacttcttcgcttaaaaattctaattgcttttcatatggtatactttgtgatgaacatcctccacaaactccaaaatgagaacatggagtttcaatctcataatcagctcgttcatctacacttattaattttaactccgcataatcttctttcttcctttttaccctacctgtaactgtttgacctggaaaagcattcttaacatatatagtcttatcttctgcataacctattcctgtagatggaaattgcaacttttctattttaacgcttaaatcgcttccttttttcatcatatactcctaagtacttatattttaaaattttatctctaataaaaattaagaatataaaaagtaatttttatattctttaaattataatagtaaattcggtttataaattaattcatatttaatatctttttcccaaaagtattttctagtttactcttttccattattggggcataaatacaatttataataaaatatattattcctcctgctaaaattatagatccattatcccttacgaacatgtatccacataattttaaaattatatcacacaatagtactaataaagctgaaccagcaatcattaataactgatcaagtgcgttagctaatataattttagaagaagattgtttatctgattcttcatcgctagttattaaactttcaacctctttattaacattgctatctgcttcttcttcagtatccgaaatctttttaatttcgttttcttccacttcatcgtttatttcattttcatttaagttatctttttccaaaaatttttcccccttgtaatctacttcatactcatttcaccatcagcaaatttgtatttctttgtagataatttatatattatacacgttttggtagctaagatttcttcctttaagccatcaattgtgttattaatctgaacttgattttcaccactttttagtttatcaattatttgtttatttatgtctgaataatctctaccttcctggtctgtaaatgcttctatgtactttttaaaagatgtctttcctaaatcaaaattattattttttattgcattctcaccatcaaaattcaaactcaactttagacttatatcaccagtctctaaattatcaccatatgttttcattccaaaatacatactttcaattttatttacttctggcttttcattgtcaaaatatatggagttatcatttacagattcatctttttcttttcttgtcttctcatcttttgtatattttacccctaaatccttggttatattctccatctttgataatttatctttaaataacttttgtgtttgatctaatgtataattttttgcccattttccctctaaactgtcatcattagagtttgtgctactttccgttgttgtgtccgttttctttgttgaactatctgtagcatttgtacacccagctaacgatgctgcaactattatgctcataagtatacttataacctttttagacactaaattttcccccttatttaaattagatgttatttttatgtctaactaatatacgacaaatgaataatacaattttaccatcagtgtattacaactatgtgtcaatattatgccttttttcttacctaaataatattatgttctcttttctagactgcttttacattcatttaatataattagttttgatataccactgtttattatatatttttttactctttcatgcaattattataacgttaacaagtattaatgtaatatatttgtaagttgttcaaacttcaatttgttcctttattcgctcaaacatgttatctcctattccagatacattttttatttcctcaattgatttaaatccaccgcttttttctctatattcaattatgccttttgcttttgaatcacctatgccatttaatgtctttaattgatctaatgttgcactatttaaattaatttttttatctgaaatatctttattactagaatttgaatttacagtttggatttccttgttttcatcatttttatttgaaatataaatcaattcatgatcttgcaacttttttgctctatttatattacttaaatctgcattttcagtaagcccacctgatatgtctatgagatcctttactattgaattttcactcattgtataaacatctggcttttttacttctccttttatttctacaactatattcttattttttgctgcaactatttgtttcttgctatcattattatttgatttattattatttttaacattaactgattcatcatttgatgtatcagcctcaatactatcatctacaaagatactttcagtatcatttttcttcagctctttaaacccagatttcacatataatcctataagtacaattaccacaataaatagcatactaaatataccaatttttttcttatcttttaagaactcttgtaccacttctttttctcctttacaatttctccttagatattatttccacttttttattatttagactcttattggaatctatttgaactttgtatagcgtaaattctttttttttgataaaatgtattttgagtacgattaaaaatatttaatataagtatggagaattttatgaaaagaatttttaaaacatttaatatattattcttgtttttattttgctttacctatactagtgtacaagcagaaacacagcctccacagattaacgctgagggttgcgctttaattgatgcatctactggacaagtgttatatgggaaaaatgaagagaaagttttagaacctgcttcaactactaaggttatgactgcaattataactttagaaaagtgcaaactagatgatgaagtgacagttcaagaagatttcaccaaaatagatggaactgctgttggtttattaaaaggtgatgtagtaactgttcgcgatttgcttttagggcttcttttggaatcaggaaacgattgtgcaaatgctttagctgatcacatatcaggaagtacagaagcattttctaaacttatgaatgaaaaagcaaaagaacttggagctttacacacaaacttcaaaaatccaagtggattgccagatcctgaacatacaactactgctcacgatttagcgttatttttaagagaagctatcaataataaagattacgttcaactatctaccacaccaaattacacaataacgcttaagaataatccttcaaagactattgtacttaacaataaaaattatatgataaataagaattctagatattattatccttttgctctttgcggtaaaaatggctatacaacaaaatcaaatcatacttacgtagctgctgcagaaaagaacggacatgttcttgtagcttcatttttaaatgcgcttgataaagatcaaaactttcatgacatgcaagcagttttaaattacggctttgataattattctttagttcacctttaccaaaaaggcgatgaagtctcacagtacaaaataactaacaatcttacaatacctgttatggcctcaagagatattgattatgatgttcctaagggtcaggaagattcagtatcttctgaaataaaaatacaggatcaggatttaagcaaacaatcatttaatgaaggtgataatatactaaaaggtactgtttatgttaatgataaagaatatacaactatggatttagctgctggaacatctagaaagtatgaatttcctctttctattaattcattatcaaacaatgcaaattcagaactctatataggatctgtcgcaattgttttagcaggagtatttggattaaggaagcttataaatataaaattaaagaaataaaaataaaggaagcaacagatgacttcctttatttttatttaaatatatattaattataaaaatttactttgcatttaaatatccacaagctttcaaatattcagctgaaagaactccgccacctgctgcacctcttaatgtattatgagaaagacacacaaatttgtaatcgaatatcttatcttctcgtaatcttcccatggatattcccattccattttcataatctctatctaaattagtttgaggtctattattctctgtgaagtatttcaaaaatttctttggagcacttggaagccctagaactatttctggaactttgaagttttcccatctactaattatctcttccttcgaaggtttgttcttaaaactaacataaactgctgccaaatgtccatttgctacaggtactcttatacattgagttgtaataatcggactattagcatttataattttacccgattctatttgtccccatatttttagtggttccttctcacttttctcttcttcaccatcaataaatggtatcacgttatcaataatttcaggacactcattaaaagttttacctgccccggaaatggcttgataggtacatgctagaatatttttaggattgtactccataagggcacttattggaggaacataactttgaattgagcaattaggctttactgctataaatcctcttttagttcctaaacgtttcttttggctttcaataatctgtgcatgtactccatttatctctggaattaacatcggtacatcatccacgtttctattggctgaattatttgaaataactggtgtttcatgtttcgcataatcttcttcaagtaacttagtttgttccttatttagagaaattgcacaaaatacaaaatccaccataccagagatttcttcaactttaaatgcatccttaactaccatatccttatatttttcaggtaatggtgttgtcatcttccatctattagctattgcctctttataagttacccctgctgaatttttacttgccgctagcactgtaacttcaaaccaaggatgattttctaataagcataaaaacctttgcccaaccattcctgtggcacctattataccaaccttcaacttgtctcccattaaaaccacctcttaaaattaattttgcttatctattataagtatgatatcatttatgcatatattagtaaaattgataatttctattaacataatcaattattttgatggagatgattatatggactttaaacaacttaatgctttcttaacgataagcaaacttcaaagttttactaaagcagccgataacctgggctatgctcaatctagtataacgacacaaattaagcttttggaaagtgagcttggtgtaaaactttttgaaagaataggtaaaaacataactttaacacatgaaggaaagaaacttttgccatatgcaaaacaaatattaaaactatcaagtgctgtaaaaaatgctgtacttaatactgacgttccaagtggtacattaacaattggtgctgctgaatctttatgtgtattaagacttcctgaaatccttaaagaatacaaaaagctatatcctgaagtggacatctctttaaaatttggaaattgtgctgaatttaaatatttcttaaatgataatattattgatgtagcattttcattaggtgtaaaaattaattcagcagaatttatatcagaaatcgaaattccagagccaatgttgcttttagcatatcctggccatccccttataaataaaaaagaagtatttccaaaagatatagagtcagaaccacttatattaacagaaatgggatgtagctacagagccactttggaaaatatattaaacagttgcaatataaagccaaatgtagccatagaaacaggaagtgttcaagccattaaacaatttacaatgagtggtcttggaataaccttacttccaaaggttgctgttgatgatgaaataaatagtggtaaacttgttcctctaaattggaaaggccctgactttggaataatatctcaagtactttatcacaaaaacaaatggatctctcctgctctaaaagaattcttaaatttatcaagaagttttatggaatcatacttacaatagaataattcaaaagctcaagcaacttattaaattagatgcttgagctttttacattgttacttatcatattaaatttatttcaatttactaattaattctttcatatcatctggaagttctgctcttaatgaaagtatttcaccactccttggagatttaaaatctaatccaaatgcatgaagagcctgcctttttattaaatcttcttcatccccatctccatataatgtatcaccgtaaataggatgacccaagtgactcaaatgcactctaatttgatgggttcttccagtctcaagtttgcattctactaaacttgattcattgtattcttcaacaactttatagtgggttatgctcctttggcctctctcatcaacaactctcctaatgccattttcaattccttcaggtttatatattggtagatcaattgtcccctgtttttctttcataattccatgaactaatgctaaatattttttttctaccttattttcactcatttctttagatagcattccatgagaaaactgatttttagcaattataataagacctgatgtattcatatctaatctagaaactaatctaactatacaattttgaccgctctccataaaataattgattactccatttgcaagagtcccgctttgataacttttagttggatgcaccaccataaaaggtttcttgttgactactaaaatatcttcatcttcataaactatatctatatccattttttctggagctatatcctgactttcatcttttgccagatcaattttaataatttctccctcatttagaactctattcatttttacaacttcatcattaacaaatattcttttaccaagagatgcacttctaattaatcttgttgataagccaagttccactttcaaatattctcttattttagtgcccttctctatgttaacaacctgtttttctaaaatactcatataatttatcttctcctcatatagtataatttaggaatatgtcaaattgataatgcacaataacgataatactccttctaatatctttgtatttttactaaccatacatatccattaagtttatgtgcattactctactagaaataagcaacatattatgtggagtgtttcattgagccaccacaaaactctaaattaactttacttaccaaaggtttcaaaatccttacctaagattataatcacatcataatctttatattctttcttgttatctttttcatcattttcttttatatttaaatcctgtttaatagtctttaatttatcagcatcattactaagtatctcacttttatcactaagttcagtattgccagtatcaacttttgtatacccagcatcatttaattcctttgctacttttgccgccaatccattaatctttgtggcatttaaaaccttaattcttatatcatcttttgctgctccttctgctgatttattagatgcagaagatgaagtaagtgatgataatatatctttattttcatttttatcaactattaaaaatgactctccatttatggtttttggtgttccacttacagttgccattgttacattttccttttttataccaataaatttaaacccatatcctaaaatatcagttggtgacagattagtttctacattatctcctaatgctgtcattattttaggtgctctaaatattacaaaaggacttgtacacttttcaataaccttagaaataaatttttgttgattttctattctatctaaatctccattagcaagtccacttccatcattattttttctccacctaaaaaattcctctgctttcttaccatctagagttacagtttcaccagctttaaaatttatatgaagattctgaccttcatcatcataaatcatatttctatcgattttcatttcaattcctccgatagcatcaatgatttcacgaaaagcattgtaatcaactttaactatataatttatatttatattcagtagattttcaacttctgattttatcttcggatatccaccaattgcataagctgaatttattttaacatttctatcatttatacttattaacgtatctcttggaacagacacaatacgaatactttttgtttgaggattataattagctacaattattgtatccgttctctttattgattgattatttacctgcttcggatctcctatatccataccaagtaacaagatatttactggctgattaaatgatacacttgcaccacttggcattgacttgctctcaaccttcattaaagcataaaccccagataccattgatactataacaaaagttattataagagatataatacctaaaactaacttttcaaatactgttgtagaatcattatcctttttaaaaatttttgagaatgctgtatctctctttttattagttttccttctcatgcacccacctcttataaattttctttacttaatataatatacattaagtaacctctctaatctcattaaataagtcgaaatttctatttatattaatacttataatttaaattcaggattaaatagaaaataatttcgtgcctttatagtattttcatcaattaataagttcctagccaataatatttttatgctactagtcaaaccaaaatagactcctttatccaagttattaaatgtagttcttcttatctcatcaaccccatcaaaatttcttccaggttctatcatatctgctatataaataatctttgttaaagtggacatatcctctttacctgtagtatgccatcttatggcatccagtatttcatcgtcatcaattccaagtttatcttttgcctctattggtgcaacaatactgtgccataaattcatattcttttcttctatctcagagataataacattattttctttcatcatttctctcattttatctatagataaatttttagcaacatcatgagcaagacctgcaatttcagccttcttttctgaaactccatttagctttgctaacctctttgctgtgtctgcaactcccaaagtatgcatataacgcttttctaataaattagatttaagatacaaattcatttcttctatggataacaagataacttcctcctaaaattaaatatatttctaaatgaatcaacttatatttctataaatcaccagaccattagctttatgaaattctatctatatagcctatttttatagataatatccgaaactctctctggcacaaaaaaatctattctcttattttcatgtactctatttcttatatcagttgatgatatttcaagttctttcaaatctaaaacaattatttttccattatacttttcttctatcatatgtttcctatttatcatatcacttttgtttattcctcctcttgagaacaccacaagagttgctagtgaaaagattttttttacttctttccacttttccatgctaaacaaacaatctgctccagttataaaaaacaattcattatctttatctctatcactaatcttatttttgaaatactctaatgtttcatgagtaaaactaagtccgcccttctctatttcataatccgatacagaaaactcgctaaagtgctctatcgctgctttaaccatactataccttaatccaggatctgtaattatattattggccttaagcggctgtattcctgccggcataaagatcacttcatctaagcttaatttttctttagcttcataggctatatataaatgcgcattatgaatagggtcaaaagtaccacctattataccaaagcgtttcataagatttcctccaaaagtattatacttattataatcatattaaaaattccttttttattatatcatgaagtaaacttaaatattatttttaatatcttaatttttataaaaaaagaagcttctataaaagcagcttctctattaattatttcctatatataattatttattaggtaattcaatttttctctttttcaaattgctagattgtttatataaaactatcttattacctattgcttgaattccttcacattttacagctttacatatcatatcagaagtttctcttgtttctaaaccactgttctctaaaacttttattttaattaattctcgagcttctaatgcttgtgaaacttgtattaaaaagttttcctcaacaccatttttacctatttgaaatattggtgaaatatcattagctaatcctcttaaataagctctttgttttcctgttaacatattatttattcctcctaaaatttttcaacatatttgttgtattaattatccctgggggttatttttcaacttataacttaaatttcactgcactcaattataagcagaacatttttatatagcaatataatattaaatttgaattaattaaagtatatattcaaattcaaaatcatttaatctaaccatatcaccgtcttttactcccatttctctaagttcatcaaaaatacctttatttctaagaaccttatggaagtatcttaaagaatctgcatcatttacatttactgcacttagtaatctatctacaaatgtaccttcaactatataaacatcatatccctcttctttattatgttcaacagtaatatcataagtaaatctcttttcttctggtatgtacatttcatcttctgagatttctaattctttaactggaatatccttaagtattcttgccgcttctttcattacagcatcaacaccttcattagtagctgctgacatcttaaatactttatcaaatcccatttcttgaactttctttttaaaatcttcaaatatgccttcatcataaagcatatcagatttattagccacaacaatttgaggtctatcccaaagttttacagaatacttctttaattcctcattgattttaatgaaatcttcaaaaggatctcttccttcaacaccagatatatcaactatatgaattaaaagtctagttctctcgatatgtcttaaaaattgtattccaagtccaacaccttctgctgctccttcaattattcctggaatatcagccattacaaaaggatcaatcccatcaacagcaacaacacctagattaggttttaatgtagtaaaatgataatttgcaatcttcggttttgcttttgttgtcattgataacaatgttgatttacctacattagggaatcctaataatccaacatcagcaagtaactttaattctaaaactatatttaactcgtctcctggcatccctggttctgcataatgaggtgcttgcttagtagcagtagcaaatttaacatttccctttccaccttttccacctcttaataatactaattcttgccccttatgagaaagatctgcaattatcttattagtttctgcttctcttataatggttcccataggtacctttatatataaactttcaccatctttaccatagcattttgaaccgccgccattttcaccagattctgcaataaactttttcttgtatttaaagtctaataacgttgttattccagtttcaacttgaaaaatgatgctaccaccttttcctccatctccaccatctggtccacctagaggtacatacttttctcttctaaatgaaatagcaccattaccaccgttaccagatttaacgaaaaccttcgccgtatctataaacataaaaatcacctttccttgtttgttttactttatcatcttaatataaaattttttagttctattattacttattctttcctaaaaaatatcgctttattatataatattggatttaatgtctaatcacaatatatattatcataaaaatattaaggcatatcaaagaaaataacatctaaaatgctagtctatttctctgatatctgtcactctagacatcggcaccttcttaactcattattttctttcatatgccttaaaaaagcactcttaaactaagagtgctttatttctaaaataattattcagctattgcttcaacgtctactgggtaaacacttgctcttttcttatctctaccaagtctttcgaatttaacaactccatcaactttagcaaataaagtatcgtccttaccttttccaacattttcacctgggtgaattttagttcctctttgtcttacaagaatatttccagcaagaacaaattgtccgtcagcagatttaactcctaatctttttgattcagagtctctaccattcttagaactaccaaccccttttttatgagcgaataattgaaggttcataattagcatgtgactacacctcctcttttattaaagttatatattctctacgtttctttttccctactaattgatcaaatcctaaaattacactttccaagcttttttcaaaagtttttaataaaacttgagcttgatttagttcttctagattaaaatcttgaaggtctaatttcaagtatccatcttgtatttcgtatgttgaattaagttctaaaacttcatccaaaccaataattacactttgagataaaactgaaactgaattacatatcatatcaaatgcttcacctactaaagcaggctcatttgaaaaatctctgtcattacctatagcgtgaccatttattacgaatccaacaatatcattattatgttgtttgatttttactttaaccataattttattatgcttcgatcttttcgattactagcttagtgtaaggttgtctgtgtccattctttcttctatagtcctttttagacttatacttgaaaactacaactttctttgccttaccttgtgctgcaaccttagctacaactttagctccttcaactactggcgcaccaactttgataccttcctcagttcctacagctaaaacttcgtttaattcaactgttgagtcaacatcagcgttaagtttttcaacgtatattacgtctccttcttgaactctgtattgttttcctcctgttgctaatactgcgtacattaaaacacctcctcataacggtctcgccacttttggtacaaagattcaaccttgttttacataaaaccttacgtgcgcggtctacaaaagccagtttatcatatttctattactttgtaaagtataatctataatttatccatataaacataatttagcatgattgttaactgatttaatacttttctataactgtaactttataatcttttaaattatctttttgcccctgaaatatcagtggttcaattttatatccttctatattatctacataatttagatatatctctttatctaatccatctatttctttcataaactcaaaaatattttctcttattctatctttataaacgctatccatttgtatatgaaaacaatttatagaactttcttcctgcatccttactatatcattttttattagcccttcaatataagataactttagaattattcctcttcctttacataggctgcattcttcttccatatattcatatatactttttccttgcctctttctagctatttgaaccaaatctagctgggtaaatgggaatatctttacattacctttatctaacctaagactttccttaagtgcatccattacaatatctctttgacttttatctctcatatcaataaaatctattactataattccacttaagtttctaagcctaatctgttttcctatttctctagccgcttctaaattagtttccaaaattgttttattgaaacttttctcctttatgttttttccactattaacatcaataacatacattgcttcagttctatcaattactatgtatccgccacattgtaggttaactttattatgcctcaaccttaatagttctttctcaattccataaaaatcaaaaagttttctatatccttcatacttctctatttttaaattttcctgtcctttggcaaagcttgatatcttatcaaaatcaatgctattatcaacataaatttttataatttcttctccagaaaaattcatcaaaagcttagttaatgttaaatcttcaccataaatctttcttactcctaatgaatgtttcatttttttatctatattttgaaattcatcataaagcttagaaatctcatttttaagaatatttatatctacatttgcaccttctgtccttactgttatgcaaacatcttttaacggttcaatattactcaatagttctattttcttttctttatcttctattctcttagaaaattctattccttgctcataacaatttaagacaatatatttcccgggaattgacacctttgcagttaatttggcgcctttatcattaagaggctcttttaaaacttctactagtatatcgtctcccttttttattccttttgcctttaattcatcactataatataggtaaccttctttatctaaccccaaatcaacaaacactgagtttatagccggaattatgtttttaatcttccccttataaatttctcctattatgggttcattcttactttcttcaacgatactttctatcaattcattattagatttaatagctacccttaaaattctttctcttctctcaacaaaaatctctttcattctataacacatcctagtcaatgcacaatgcacagttcacaatgcacaattagtgagcaatttcctttgaaaatctaattatcatataatttgataccttagtattttgcatttattataatttttaaaatctcttaagagatttattccttaattgtgtattgagcattgtaaattgtgaattatatatttatacacatttatataatggtacaagtttattattcttgtaaaaatacatttcttctcttttggtattaacaaacgaatctaaaatcgcatttgaagttttttcttggatataactaacaagtaaatctgcgcttaaatgttccctacttcctgtacttataactgaattaagaattaagaactcatctttaacccagaaactaaactccttaacaaaagcccttatattgacttctctttcaccttttttgcttttcttgactgtattccactcattagtttctaaaagtttaccaacttcctcttctaaatttgagacatcagaatacttaatttttatagtatatcttgctgcatcaattaaagccatagcttgaggaactttcttctctccttctttataaggaattgcaagtgcacttatatattttattccacttggcgcggtctcatttaatttatccacaatttcattttcatccatctcagttgttaacaccatatccatatattcaccacttgaatagactcctaccgataaaggttgtgctattgatgtattcatatgggggttaaatccttgagagtattctataggtagccccgctcttctaatatttttttgaatagttttaagcacatctaaatgagatatgaacttaatattttcctctttagtaaatttagttaagtatcgcaccttcaaaacactccccatctttaaagttcacattaattccacatcctgtacatccttctctacagttttgtgttaactctgctcttttagctttttcattttctatttctaaatattttctatttactccaatatcaatgaaatcccatggtaatacttcatcataacttctttctctatatgcgtagaaatctacagttaaattacactcttccattgcttccatccatacgtcaaatttaaagtgttgatcccaaccgtcgaatctagcacccttttcaaaagctttaattaaaacatcacataatcttctatcccctcttgcaaaaacagattccattacagatgtcttttgctcatgatagttataaactatacattttgatttaattgaagatttaacagctttgattttttcagtaacctcatcaaacttcgccattggtgaccattggaatggagtaaatggtttcggtataagtattgatgtacttactgtaagtcttaaacctttattattatttatcttattaggcacttgtttatatctatatactattttttctgctaattccccaattcctctgcaatcttcaagctcttcatatggaagtccgaccataaaataaagctttaaagttttccacccagctgcaaatgcacttgtagctgcatctaaaattttatcttcagtaagacccttgttgattatgtccctcattctttgagaacctgcttctggagcaaaagttaatcctgtttttcttaccttttggatatccttaagcaaatctactgaaaaagcatcaactcttatagacggaagtgctataccaactctgtcgtcttcatgctcattaactaaatctgtaattaatccttttatatcagaataatcgcaagtacttaatgaagaaagagaaatttcttcgtatcctgtacttttaactaattttcttgctaaatcctttaaatcttcccttgtcttttctctaactggtctatagagcatgcctgcctgacagaatctacatccatttgtacatcctctgaataactctagaactattctatcgtgaacaatttctgaatagggaactattatatctgtaggaaaatctaccttagtataattatttataattctctttgtaatagtttttggtacgtcatcatacttaggtctaaattctttaattgtattgtcttcattgtaaataacatcatataaggaaggtacataaattccttgtattttagatatttctcttagaaattctttcttctttccttttcctttatacttcttataaacatctaaaacatcattcatcatttcttcgccttcaccaatttcaaagaaatcaatgatatcatataaaggttctggattatatgcgcaaggtccaccagccataactattggctcatcttctcctctttctgatgctcttatagtaataccagacatatcaagcatatttaaaatatttgtataactcatctcatattgaagtgtgaatcctaaaatatcaaactcctttagagaatcttttgtctctaatgtaaataacggaatattattttttctaagctgttcttccatatcaggccatggtgcaaatgatctttcacaatatgtatcacttctttgatttatagtatgataaagtattctgcttcctaaatgtgacattcctacttcataaacatcaggaaagcaaaatgcaaatcttatgtcaacttcctttagatctttaacaatctcatttaattctccaccagtgtatctacttggtttttcaactttaaataagatatcatctgaaattttattcattaataaatttcctccttaaaacacaccatcatatgtgcaattctccataaatgcttgcctttaaatttttgtcaaatttaaagaatttaaaacctttagtatttcaaatactaaatgaacccactttttgcttatgcataaataaaagaagtataaactctaattgctatacttcttatttgctatccctattctaacataattaattctgaatgggaatattcttattgtttccaatactatatacaatttattttattctacatttccttcaaagcctttgaatttttatcattgtatttcttactatatctccaatcaattatccataatataaatgataatccggcatttataccaaatacaaatccaaacactccataaaggcgaagcttattgaaaaagtctcctacaaaggaattgaacattacatcaatttcctttggattgagcagctcaatttgcttattgcttatattctttagatttatttcccttaatattggcacaatataatcaccaactgaatttaaacctgtttcaatagttttacttataagataatccttagatctatctgatataaagttaaagttgttattaattgcattttgaactatagcatcaattgcaatcataattttttggttaaattctgcattagcgaaaatatatttaataatcctatcaagatcattgcttagagtacttgcatcaataatttgttctatctttaattccgacaatgtattttcatagaaattttccataaacatagatatcgatttttttgattcttcgctctcaacaattatgcttaaaatattatttatacaattttcaatttcatagctatcaattccctttaataatacagaattaaattcaatgttaaataaatttttcaccatattttcattaaagaacttttctattgttatagataatttatctctattaatatttatgcttctgcatatatcttcttttatgatattggcttcatcaaaaaacttcttataaatcgaatccaaagtgcttaattcaaataattcaagatactctgaaattgaagccacagctaatgaatctaaaatcaggtcacttgctctatagatataactctttaaattaacattctcaccaaattgctcaaataaatcatctattattatttgagtgttaaattcttcaccctttatatttaattcactcactctaatagggtatatattttcatttaatacagctttcgtagtattaataagtttatcattctcttctcttagcattaaaggaagttttttatttagtataatatcaacaactctatatgctatgtcatctccaccaaaagttgcataggctatcttctcaaagaaattaagttcactcttaatagtttcttgtacattttcagttataatattctgattgtttcttaagtatgatattaacttatttgaaaaataatatgttatatgattcaggttattatcaatcatgttcttgaccttaccattaaacattgatcctatatcattattttcatttaagccattacataaatatttacttgtcatattttctaagtatattttaaagtcattagaaaaatactcatatacatatttccctatattaatttttgctttttctatagaatctttacctataacctctttacacgattgttttatcgctgcagaataatcatctttgtattcttttgtaattaactctaaaaaatctaccttttcaatagtactaagattatcttgtataaacttattgccttcctcttgaatataattttggattttaataagtatatcttctgaaataacatcaccaattttgtaatttgaagatattctattttctataaacttcgttaaagaacttttactattactaatactacttattattttaagtattccattctgaatgtaactttccttgataaaatcatcaaatttgctttcttttaatctgttagtaattccttcggataaatctgaactactattacaatactttaaaattattttatagatataccttacaaaatcattctttttacttctagcaaagttaactaaaatttgataattattatttttaactaaggtagttagtactgaagacatattatctttatgagaattgaaacttttattaatttcctctttgtttaataattcttcatcaattagtttcgccattccaatagcaaactcatttttatgtgccggtatatatcctaatgcaaacttcttaaaaaatggtattttagatataattttattttctttatatggatggaaaatcatccacaaagctacaacatttgttatgtatcctataaatcccataactccaagtgacaacaatccattaaacatattacttggaaatccgtagagtccaatagaatttggaaatattaattgatatattatcccaactacagtacctaaaacagcgccaaaaacagaaagtggtttaagttgactttccataaaatcttgaactatatcgcatatttcatcctcatcatatttacttaaactattttttgcgatttttttaatattcccatttaatagatttggaagcttagatattaatgctgggtaacctttatttataagaatatttgataattgattcttattaaatcctttattaactaattccttaacttgataattcttatatttatccacagcttctctataaattgatactgaattatccacaatatattccaatatgttcacattatagtttgataatatatctcctattttaagttttttaacatttgataatatgacctcttctaatttctcgctatatgtatctttgttctttctgaacaaattattcgtccatattgaaaatttattagataaactaagtactctttcgtctttaaataattctgataactttttgtggaatatttcatcactctttgaatttatgaattttgcaatcaaactatttatgtttttacataatctcgttttgtttttaaaaatactttcatataacattggcttaaactttgcattgaataattttaacaaatctaacttagcaatctcatttactttctttgaaaattgaggttttattagtatcctcaacgtattctttccatgaactgcaaatactttagtagcaatttcagcaatctcatcagatgtaactaaattgtatttctccaatgcttctactatatttttaacctttgtgtccttcaagtaatctataatagaagttactattttatcacttgattcattatcaaaattattgttaatatagcttataattttattaactatattatttttagatgaaacatctcccataagtgcatttctaacctttgagattataagtttctttatgctttcatctatatcttgtatcgcttcatcaattgcggattcaatcatttcgtccaaagatgatttattacttgaaatccactccaaaatataaggcatgaccttaggaataactatttttataaaattcgtgagtgatttttctatctctttaggaagtatttcataaagagtaaaatcaatatttttcccaattgaaacaatctcatttgtaatttttaatattaaatcctttccttcagaagagttaataaattcagtaattttaatgaataatcttgaaataacttcttcttgctgagtttccgtaataaaatgattaatattccgacttacgatagagtcttgtaattcgacaagcgttgcatctacatttatatttgaaagcatattgtccaaaaacatcttgcacgacttttcatctgataaaatatcgttattaaatatgttttcaacacactcaataatattatcagttaattttttctggacttctttagaaaaaatatcagctaaagtaatattagaattttccttgtataaatcagaaataaatccattcactgcatcagcattttcaagttcgcaaatcagtagctcatagcatgaatttataacttttgatgtctgtttttcacttaatatatcttgcagatcaacatcacgcataaaaccatctattaattctggtaaaagtatatttagattgtttcttataaattcttcacttttaagtatgccatcagagaaaccatctatttcagctattttagtatttcctaaactattgcttaattgcttctcaaaaaaagtttgagccatttgttcaatatatttatttatatttatattaggaatttcagaccttaatgtatctgcatttattatatctctttctactaattcgctaatctcttcaataaacttctccttcttctttttaattacccctcctagctttaaaggtgtatattctttaaaaagcatatcaactgcatatttatttgtgatatatccagctactccacctgaaaatccctgaaatgctaataaaaaaataaatgttaacatcagctattctctccttatgtaatattaattctaaacaataactttttcacatataaaatatgttgtttacatcatattatactaatttattgactttatttccacatctcagcctgcaacaacaaaaagtgctaatcctcataaaaagattagcacttttattaaattattttccgttgttctttattaggttatataaaattacagccgcttctgcattgcttatattatgtgacccattaaagttcccattagtatcccctttaatgatattaagagcatagcacattgatgcatatcctttatatgagtcttctatattatctttaaaaggactattaaatatttcagaatgtccagctaatttctcatagcctaagtatcttataataaactttgctgcatcattatatgatactactgaatttggagctttttcttcatctttaattactccattttgaattaacatatcataaaattcatcatcgctataattattttttactggcgaatatatatatttaaagaaatttatttgagtaatattcatattaggattaaatttttccccatctatataatacccattatctaaaagttcttttactgtcttttcacaccaatgcccatttatatccgtatattctggtaatttattttctctatatgcttttccggtataatctatccttatgccatttataggatcaataatataactatcattcttgtttataaagtcatatactattccaactttattttcatctaacattgtatattgtaatgagaatcctgctaaatccttaattttattgaatgcagcttctttatttataacgttactaacatcaggaaaagaggcattatcataccagttattatcataaccaataattttacctgtattcttatctacttcaacattcaagtaatttcctgaaaactctattccattcacttgacgtacatagttaaacataaacgtattttcttctattggtctatcagtaatctttaaaattggattatttatatccttaaactttgtttgtgtaaacttattaggtgctacttttttcaaaaagttttctactgtgttttgcgcatctgccttagaagtattaccacttgttccaagtttattataattataagaatgtaacgatattacttctccagattttgcattcactcttccatatacaccgtcaaaagaaatattccatgaatattcatcatcaagatagtttttatttaatgatgcatcactaactttcatatcagccgttattaaatcagatgtttctctaagtatactttctgccttttctttacttataagatttgcaacattctgaatcgcatccatctcttcttgtgtcaactcttgatttgctttatccaaattatttgcagaagcatttactaatgaatgatccttatttctatcatctaatttattatcacttgaatatgatactacttgtccagttttagcatcaataaattcacttatattacttggagaatatcctgcaaatatattcattttcttcttctcataatcataataagaataatattttaaatctatacctattttatctatatatgctttttctgcagtaacagaatcaattatcccacttaaattaggatattcagctccctttacttctaaattgtcattgctaaatgatgtcactttcccactatatttatttacaccaacatttacataaatatagttaaccggaatttcatttacaaacttttggtaagtaaagttatactcatccccttgaaaagaagctgaatcattttttactaactttatttccccaatatattctggaattacatttttcaaaaaatcttctgctgaaacttgggcctgatctttcgtaatatttgctaaaccatctttgctatccttgctatccccatcataattactatattgatataagaatccatcttcacctattgatacagatattgatcctttcttatcttctttttctgcccaatttaaatcccaaattctaacttttgccccccttacttcacgttcgcttgaattatgtgtgaactctgtataatcatccggaactgttataattttctttgctgatatgatagcttgctctaagtttttgctatcttcatccgcagcaaatgtcggaatagaaatagtagacaatattaaacataatgttaatatcccgcttataatccctttctttttcataaatatcctccaatctttaataatgagttattttttatactatctaaatataatacgattcttcatatgaaaattttgcattaaattataattttttcacaattttttatacagttacttttaaatacctgtgttaaagcaataaattaatattttaaatttttgtaattcataaaaaatctaaaattttctatataaaaaatggagttaataattaattttaattattaactccacactactaactattatcatactatgcgtctattaatattttcttctactttatgttcatctatattttgttttatttttaatatagatgacaaaactactctcactaaaatattactaaaaaaaatatctcgccttttatctcctaaatttctaatataaatactgtgcatatcttcaatataatctactatatcattcatagactttaattctattctggattcctctgtgcattcattccacacttcagatagctttttccaccataaaattctttgagtttgttcatataattcatgtctaataatatttccttcaaaagctttattatgtggaaaagtaaaaaaatcacataggtaatgactcaatattcctagcttaattgaaatatccttatttcttttaatttcaccataaattatttcatcaataatccctataaccttctcccaatcctcatttttactatgcatagtcattctatatttgagctttaagtcaggtaacacatttccataaataaaaaagttactatcaataatatttgagtagcctctctcaattaattccttgctaagaaaataacctattttcccatgaagtaaagtatccatattaacgctcctaccctttttaatcacatttagagagtaataagtaagtaattgtctgaatcacaatgcaaaagtgcattttcacacataaaagatacatttttattatggtactagttattactcttcatcacatgcttaaattataaaaaaagtaagttaaatcaccattacgtttctgttattttttaacgagcttaattatttttcttttttaattgtacatactcttctagtgttatatttccataatcctttaatgcttttataagctcatcttcatgtattatactaatgagttccatgtcatcattaagaatataaaaactgttaaatttgtttttatcaactaaagataaaacattaactaaaccttttttataatacacagaaattgatttattctctatatagttatgcttttttaactttcttattttcttgatcatatctcccattattatatacatagttttttctttttctataaatgttgcatatgtgattaatatgactgcaagaaataaacttatattaactttatgtaatatcattattataataaatattaaaaataatgttcctgaaataataaagctaaagatttctgtaattttctttgatcttttatataatagcttctttgataatagtatttcacatacccttgaaccatcaagaggataagcaggcaataaattgaatgctcctaaaaagaaattaacttttatactatcttcaataatttgatacttaaaatatccatataaatagcacataaccacggccataaaaatattgaaaaatggtccagctaaatataaaatcattttttttctttcagttaactcatcgatgtcacttaattcgactttagcaccaaatatgctaatattaacattattaaatttgcacccaaatttacttgcaactatcatatgtgcaaattcatgcaatattacccacagaaaactaataacaatgtaaccttcataatctccaagccacattaatatcgacagttctaaaatcaataccatataccatttcttcatttctaacccctataatattgctatatcaaaataatttgcaatgcacaagtaaaaaatggaacctaatcaaatattaaaatatattttatattcataataatatgttatttcctataaatttaattgttcatattactgttgcttcttatatattccataaaattaaaagtccttaactttaaattttcaattttcaaatcatctacagtaaaatttccaatctttaaatccttaccttttatatttcctatctgcattgtactaaaagtatctatatactcgttataattaaaatttcggtttaatgcttgtttacatttaatgtgcatttcttgtacttgtgcgtaaggggtatacttcaatccaacaaaaaatagcaataaaagtgtagctccggttagttccttagttattctcttaatcaaaacatttatcatcttatcgttacttttcatattactcccatatcttgaaccaatgatagcattattagccttcttacctgaagtcaaatggttccttttatcctttcttcctttcgttgtattattaatgtttttatagtaatcctcataagctgatctatagctgcccatgatacactcctttcaaattcattcacattaaagtatatttactacttcataaaattatgagaacaaaattgttgcagaatctttgtatttgctacattccgcaatatttagatatcatttaggttgcttaattaaaaaaatacaccgcctagaatttttatgcgactaatacctactcttcgaaaatcatctattttataataaataatccttaaaaattaaaataagattaataattttatactgtactcaaaattattatttgcaatttctactgtactggataaaattattaatcctattattttataaataattttgctatattcactataattattttttacattttcctccaaatcgagcactcaacttattgaaattgtagcataaatttattatagcaacatgcatattctaaaagtgtatcttttttcttctcattcctacatttattactagtgctattgaaatcactgttgtaagcaatgaacttcctccatagctaacaagcggcagggttattcctgtaattggtagtaatcctattgtcatccctatattctgcaatatagcaaataaaaaatatgacactattccaacacatataactgagccaaatatatctttagatgttcgtgctactgaaatcatcttatatataagaaatccgtaaagcattaacaaaacaattgcacctaaaaagccccattgatctgctattgcagcaaaaataaagtccgtctgaacttctggtacattttgtgcagcatatgttgtaaccccatcttgagccagcgacggactacttccaagtaatccacctgaaccaattgcaatcaacgactgatttaaatgatacgtacttgcatcatcgatgcttggattcaaaaatgctgtaaatcttgctttttgatatgtttctatgagtcctgaattccacacaatcactattccaagtactaagcaagctaatcctccagcaataattctcgtatcaaaccccattgtataaaatattcctaaaactataaagaaacataccatactcattcccatatcaggttggattacaataaatattactggtactatgcaataaaatgctagtgtgaaaaaattcttaacatcatttatttttccgtccatctcatctaacttcttacccagcataagtataattacaaactttgcaaattctgacggctgaaggttacctactcctaaacggatccatcctctagcaccattaactactattccaatccctggaaccatggttaatataagaagaactacaactccccaatataatataggtacatagttaaatattatcttataatctactgccacaaaaatatataacgctacaagtgatattgcaaaccaacccagctgttgctttacaaaactcaatccaaattgtccttttgtgcatagatatatattaaatgttccgtataaaattaaaagaattaaagaaattaatatagtcttatcaatttctttaattaatttcatatctaattttaatagtctaaacaatatctcacctcctagttatattaatcttatataactcaatcaatcttaattatacattattattaccgcattctccataataattatattgggtataaaaaacataataattttgtaataatttaaagataatatcttgttaaatacccaaagtcatccatattgaataaacttaattattataaaaaaatgagatgacttgttttaaagaattagccatacaattctttaaaacaaacatctcttataatttaaacaaaacaagttacttatcttccctttatacttttaattggaatgttagctattaatgcagaagtattttcaccttcttcatctccattcttatttacggatatttcaacatcctcaacttgtatatcaatatacttagaaattacttctaaaatctcttctcttattttctcaataatatctggggcaatttctcctctatcatgtataagaattagctttagtctgtcttttgcaacttctttaggtgttggcttactatttaaactcttaaaaaaacccattctctcaacctcccttaatttcgcttaaatagcttctttaaggagctaaaaaatccctgatgctcttctgtatgtaaatcaataataggaacttcttcacctgtaattcttctagctatgtttctgaatgcttgtccagcaatcgcaccttcttctaacacaataggttcacctttattagttgaaatagttatattcttatcatccggaactactccaagtaactctactgataatgtttcaataatatcagctacatcaagcatgtctccattcttagtcatttcatagttcaatctatttacaataacagaatggtcttccaatccctttgaatcaagcttaccaataaccctatcagcatctctaacagatgttatttctggatttacaacaataattgctttttctgcacctattacagcattttcaaaaccttgttctattcctgctggagaatctattaagacataatcaaactcttcttttaattcatttactatttttaacatttcctgtggacttatatcatctttatccttagtttgcgctgttggtaaaagaaataaatttgcaaatctcttgtcttttataagcccttgttttaatctgcatcttccttctataacatcaattattgtatatactattctgttttctaatcctagcaatacatctaaatttctaagccctgtatctccatctataacaactactttcttaccaagtgatgctaaagcagttcctatattggctgtagttgttgtttttccaactccacctttacctgaagttattacaatagatactcccattaaaaaatccctccgacgttttagtatatatatttatttggtaaatatggctccactattatcaacccatccctaattcttgctaattctggatagcttggcttttcgatatcatctggagacatagctataacatttgcaatttttaatagttcaggttgtagtaggaatgctgctattaccgcttttatatttccattagtcccagcgctcactttaccccttatacgtcctaaaacaattacattccctgctgcatatacttctgcaccactatttatgtctcctactataactatgtttccttgataattaatacattctccgcttctaactgtctttcttataaatttagttttcccttcgtatacaccggaaaataccttaacctctttttcgttcacctgctcaatttccttttctatatcctctagaacaatatcttttaattcaatttgagttaataatttttctttaagaatgcctacttcctttttattaaccaattttaaatctattcttaatattagagttgtccctttataaaaatgctttcctttagaaagtttctttattagtaatacaagcatatcatcaaaacaagcaaatttattcatattgatagttgtatttattccatctttatttccctttattaaaataccatcattattatacattcattccctccaatgaattttgcaggttaaaatagttaaattgttttgaaaatggcaacctctctaaaattatatcattatactgactatttttgtatatatgtttcactaatttttgattaaattttacaaaagcatataaaacatcaaaatttgataatatgcagtgtatataccaaagcattgaacagctatcacactataatattacatcaacataatcccttatattaatactgtcttcatctactaaacagtctactgcaactatatttacaccattctcttttgcatattttagtgtatctccaaattccttatgagtctctacattaggttcaaaatgaacaacttctttcatttgtattacaaatattacgtaagcatcatacccttctttaatgcaatcaatgagttctctaagatgtttaacacctctttctgtaggtgcatcaggaaactttacaattccattattctctaaagtcaccccttttacctctataaaaattttcttatgctttgtctcaacataaaagtcaaaccttgaattcttatatttagcttccggttttattaaagttacatcctttaagaggttcccttttaatatccattcatgaacaaccttattagttacttgagaatccatattgatcattctgtctccttttacaacacctataagagaaaacttagtcttcctttttggattatcatttttttgaataaatactgtcgcattgggtatcaaaagttccttgcaccttccagtattttttacatgacagacttcttcattgccatcaatttcaacataagctataaatctatttggtcttaagataaattttccttttagaatattattgtatttcatattatcctcactaaatctatttttttacaaaaaggtatctataattaggtttactttatgcaatttttataattgcatacctaatatagataccttacaaattaattaatttttatcaatttatatttaaatacaaagtctctattataaatttttattaatgagttttatttgtattcgcctgtgaagcatttgcttcttggttatacggattacctaaaacatattttttccatgtatctgacgatgaagtatactgtgtatcattctttaattgatccttgaaataagcatcataaactgacttcactactgatgcaatattacttccatgaccgccatcaaatactactgctgctacagctatctgtggatcatttgctggagcaaaactgacatatgttgcaaaaggttctcttcctttttgtaattgatcctcagcaaaatcggctgtaccagtcttaccagctgttggtattggatatcctaaaaatgtagaactaccggtaccatctgcttcttggttaactgctgtcattccttgtttaaccgcatcctgagtttcctttgacattttaaccgtatttaaaacttctggtttaaactcttggactacatttccatccccatctgtgatcttatctactaaatgaatcttatatcttgttcctccatttgcaagagttgagatgtatgatactaattgcaacggagtgaaagtattcattccctgacctattgatgctgaaacaagggaacctggtgatcttacttgccctggctgatcattagctgcaaattgagctaatgcttgtgatattaatgtagcttgagaatctaaatttatatttcttcctgcaatacttgctttgtattcgtctgaattattcatcaaatttaatacatctttcttaatatctttagcaaatgtatcatggctaaccgctgttggatcatcaacatctttatttattgtatctttaactttatcttttatagctttcttagacttcttaacttcatcattatcatcatctttatctcttatatcaattggagaaaagtatattgtattattatagtttccactctctagaaaattaattacattatctgtagacatctgtaacacagtatttctccatgatgtaaaattataagtttgaccaaaactttcatttatttctattcctgtcgattctttagcactactattaggatcaattcctaatccaaactgccaagcatatttagcaagggaatttagagcttcaacattattagccttgcctcctgcctgaatatacattctagtagcagtctcataaaaataaaagttaatcgattttgctatagctgctgttaaacttatattaccttgtgcagcttctagtccttttggtgcaaaagctttaccaaaaatctccggatgaatattaaatgctcctgtatcatttatcatttctccaggacttattacgccagactccaaaccggcaactgctgtaagcggcttaaatgtagatccaggtggaatttttgactgggttgcataattaaacattgctttcggatatagatcatatggatctgttctagttccattttttggcggaaacaaatcatcaacagttttattaagccccattcttttaataaattcctgtccaaacttctctaaatcaggattaaaataatccttatactgttcaggcgttaattgtccttgaactgtgaataaatttggattaaagttagggtaacttgttaaagctaatactcttccagttttaacttcaacggctaccaatgcacctctggttgcattcaacagtctatttcctttatcatcactttcattattccttatatattcaattttatctgctaatgcttgatctgctgcatattgaatgtccctatctattgtaagatgcacatcattgcccggatacggttcaagtttaaataattcttgtgaaacgcttcctttagaattaactttaacagttgttccacccttaactccttttaattgttcttcgaaagctgattctattccagactttcctacagagtctgatgaaacatcatatcctttaagttcatatgttgatttttgtgtatcattaattgaagatacataccctaaaactgaagatgctaaattattatatggatatgaccttataggtgctgaactcacatttattcctggcaaatcatatttcttttgcattactactaatgaagtatctttcttaatattgtctgcaatacttactgatttatatcctttaaaactctgcatttttatagcatcttttacaagcatgaattttctaatatcatttaaagaatatccttcttttaaaatcatatctgttaaatccttgccttccattttggaataaatattcttcttttcttttgagtcataatctgggtctacaaggccaattaaattatatgatttaactaatgcataaaacgcatcatcaggagttatttttagaagttcttcatccagttttgcattttgttcatccgataattcttcaacatctttgaacattttgttttttagagtatcattcaatcccctatcctttttaaatctcaattcctctatattttgagattgtttatcattagttttatactcaaaatataaattattattaccatcaatttttaaaggtaacgaatcctgaatgctttctccgttctcattcaatattttgaaaagttctttcatagttatataaaactgtttatcagcatcttttgtttccgtatatgtaatagtgtatgtttcaatattagttgctaaaacatttcctttatcatcatatattttaccccttggggctttttctgatataaatcttgttgatgttacatctgctttatccttatattcatcataattaaatacttgaatatataataattttagaataatcactgaaaatatagctatcatgattatagataaaactgtatatctagaaatcttctttttctttttattagttggtttatttactatcatctaaacctccatctttgctttgaatactcatcatcataaacattcattactaatttatacacaaaaaacattattactccgttgtatacccccataatgatacttttagaaaattgtatttcaatattaaaaaaattaaatatcaacataactcctgcatatttaattattgttataaaaaaagccgagatcacaggtatcagtctcttagtctttattattcccgctccaataaaacttgctagaagacatagaaataaattcaataatgaatttacaccaaaaccattaaaaaagaaaatatcttgaagtatcccactcacaacacccataaatacagctcgttctttcttattgactaatgaataagctatagcgaaagtaaatagtaaactcggataagctccctttattgaaaaaaacggaattagtgagttatctaatataaccaatcctatagaaatcaaaataataattaatttttccattataaacctctaattatatttaatttctctcgtatccttcggagagacaataaataattcttctaacttattaaaatctacatatggttttacaactgcattcttcattacttttactttatcttcttcaactgaaatcacttcaccaattctaatttcctttggataaagcatccctactccagatgtcattattacatcgccttccttaacatctgaattcatcggaagatcatataccttagctaagttttctcccttactatctttgaaaccttttatataacctgtagcatctctggtactttgatccataacacttactgctatattttcattaatcagagattgaactatgcaccaattacttccaacactggttacttgtcccactaaaccttgagctgctataacaatcatacccttttgtatattgtcattttttcctttatttaccacataaccatctaaaaagtttccaccactatatcctataatatcacatgctacatagttataattgtttctttcttcctgaaaattcaacacttgtcttaatctatcattttcttcttttaaatctgaataactggctaactcattttcaagttcttgattttctttaattaattctttattttgcgcttttacttctgaaaaattcaagaaaaaatctaaggtttctttaatcctactagttccagaatataagagactttgcactggatttaaagtactaccggcaccactttcaataatacttctattatcctttctaactgtataaactattaaccctaaaaagctaactgacagtactataatagttactgccagtttattcttaagaagcttcatatttaacctctttgatctctactaattttatcaaaatcttctagtgccttccctgctccaagtactacgcaatcaagaggtgcctccgcaatatgtacgggcatgtttgtttctttatttataagtatatctaatccttttagatatgccccgccacctgctaacattatacctttttccataatatctgctgaaagttctggtggagtcttttccaatgttgtcttaattgattctataatagcatatactggttcttttaaagcttctctaacttgagtttctgaaatttcaacaatctttggaaggccagtaatcatatctcttcctttaatctccatgactgtttcttcatctgaagtcctataagctgaacctatttccattttaacttgttcagctgttctttctccaaccattaagttaaattcttttttaatataagatattattgattgatctaactcatcaccagctattctaagtgacttactagttactataccgcctaatgaaataatagcaacttctgttgttccaccaccaatatcaactatcatacttcctgttggttcacttactggaagccctgctccgattgctgctgccattggttcttccattaaaataacatctctagctcctgaaagttttgtagcttcttcgatagctcttttctcaacttctgtaactcctgatggataacaaactattattcttggatttttaaatgcattcttagttgatactttttctattagacttttcatcattgtttgagctgtatcaaaatctgcaattactccatcttttaatggccttatagctactatatttccaggggttctacctatcataagcttagcttctgatccaaccgctaatgtctttttagtcatagtgttcattgcaacaacagatggttctcttaaaactattcctttaccttttacaaatactagggtgtttgcagttcccaaatctatccccatatcttttcctgatccaaaaaatcccatttatttttccccttccaattctatattagtcctctttctttgaggctaacaaatttattatttcctattataatatggtctactaattgaattcctataatatttccacattctttaattcttagtgttatatttatgtcttctctgctaggcgttggatcgcctgatggatgattatgacatataattatcgatgcgctattcttacttatagcttgcttaaaaatttctctcggatgcacaaccgacgtatttaaactacccttaaaaacatctttaataccaacaactatattcttggtatttaataagacaacttttaatacttcttgatttaattcgttcatttctcccatgagaagacttgctaggtcttttggtgaagttattttgatgtcattatttattgctttcaatgttctaaatctcttaaaaagctcagctaaagctaaaatttgtgaagcttttccttgtttaataccttttatagatattatatcatcaaaacttgcatctaaaataccatttagcccttctagctcagataaaagcctgctgcacaattgaagaacattctctccttgtgttccagtcctaattattattgctaataattctgaattacttaaagattctgctccataagttaataatttctctttaggtcgttcattttgtggtatgtctttgattttaaggctactttccatataatatattacctccaaatatatgatttcccctctatccctaaaatataattattgtatctctttaagcataaactttagcttattcagtggcagtccaacaacgttgtaataacatcctcttatctcttcaacaaatattccacctatcccctggattccataagcgccagctttatctaaaggctcaccagtttttatgtattctaatatttcatcgtcgcttatttcagaaaaagtaacttcagtagataaactctcttgaatcgttaaatttttagctgtattaatcacaacaacgccagaataaaccaaatgctttctaccttgaagtgattttataatattaaaagcatcttcttcatctcttggttttcctagtatcatattgtctatggtgactacagtatcagctgaaattataatcgcatcctcatctagcttattcttaatattcattgcctttcctaaagctatgtctttaacatatctatctatagagccttcaaaaataactttactctcatcaaaattgctgacaataacatcaaaagtcttaattaatctacttaagagttcttgtcgtctttctgaagcagaagctaatattactttcatatattcacatcctaaaataaagaattttggcacatgaaaaataataggcgagcatgatgatctcccattttttgaatgtaccttattatatatcattgacaaataatatatattgtagacatgttaattttttaaccaaaaactattaaattttaaaggtgtagaaatgatattctaccatttctacaccttatagtttatcatttaagatgttcttaaacaagtgtgttatattaagttataagtttttttatataaatgtaattttgttgtaataattattaactaaatctttcagtttttaataagtttatataactcctgcatatcattactactgttcgttttatccatttcatcaggcagattttttatataatcatataattggcttatcttatttgattttactgtgcttccttcatttacaattccatccgtccaggctttaaattctgctgtttttatacttttcacctgattatcttgtaacttattcacaattgtcaaaaatccattcataatttctatgagctttttattttccaagtcatcactagaagcacctaaactaattttagcgacatcaatattattggacttgaattcttctatcttttttaagccatcttcctcattgtatattcctgctaaaactctatatttcccatcatcttctactataaatggctgacagtattttgatattgcagatagtgactcttttgcattctcctcttttgaataatagccacattgcagtgcgatgatattttttattgcaccattatagtcaccttgagttgaagcctttgagctatttatacctacgttttgtacactcttcccatcaaagacaacattgctaataagcactcctccaactatagatatcccaacgataacgacaacactacataaaaatttcatcctgcctgattttttatattcatatcttgtgtatctcatagtctccccccttttgaacattctaaaaatagcgtgtcaaaaagttaagttttatatgttatcaaaacttatagaaaacattataaaacagaataatattatatatatttgacctgctattttttcagatttcttatatattaatatttattctgtaagttacacatatatgaattatgttaaataaaaaatattatatagggaatattttaaaaatctaaacttatatattaacaatattaaagctattgaaagaaacattcatacattcctaagcatacttatatatcatttttaactataattatgtttacatttagtatcttaagttaactacatccattagcaaaaaattcttcttgcagtagcatatctttctgaatagtacccatcacacaatgaacttaccattactggttttccagatcttggtgcgtgtataaattctccgttcccaatataaatgcccacatggctaattgaaccttctgtattaaaaaaaactaaatcaccagctcttaaattacttttatctactttagtccctacatttacttgtgtatatgtagttcttgatatatctacaccaaatttattataaacatattgtgttaatcctgaacaatcaaaagcatttggaccaaccgctccataaacatacggctttcctaaaaacttatatgcataatttacgacttcatttcccttactaattgctcctcttgatactgaatcttcaccatttgatactgtttctgaatctgatggtgcttttatcactttagctgttttaagttcactagtcttaattgtaattcctctattatgtgttaatgtagtatcagctttggcatgttgcatattaataagaaaaactcccgaaaaaataaaagttgtaattacacatttcataagcctattatttttaattttcatcttaaattcctctccatacctaatctatattaccctaaaaggcactttagttatcgtttacaccttactgcaaattttaaaacatgtttctagtatagtgataagctaggtaaaggtcaaactttttatacttttatattcttatttataccgaaatatctctaatttcctcaatattgctatcaataatggtcatttactgtaaatttataattttctgacttttgttttacattttgttatttcttactcattatcttttttataaataaacttaaaactcaaaatcctgagaataataaaaaaaaacagtaagttatccaataaattttctggttaacttactgttctaattaattttttatactaatttctaatttccttaagaacttctactaaatattcaaagcatctacaagcagaagatatacttaaatgttcatttggagtgtgtatatcaatgatattaggcccaaaactaatcatatctaaatctccaagtctttccttaagtatcccacattctaatccagcgtggatagctacaacttctgcttcttttccatacattctaaggtatacatctttgcatatatcccttatttttgaatcacttttatatggccattctggatatcctgcggcagactcaaatgtacctcccataatttcagttaaacatttatttctttcaactatttcttctttcaatgaaaacacagaacttctaacagcactatgatattttatatcactttcattggttgttaccactccaagatttgatgaactttccactaatccttctatttcagaactcattgtgtttacaccatttggatacaaatatgataaactaattgctttagttgtagtatcatctgaaaatactttttctattttatctttactttcagataatgttatcttaagtcctggatcttttgtgctcaattctttagaaatattactatctatctttgttttagcttcaatcagttctttttcctttgattgatcaattgaaataaccgccatagcttctcttggtattgcattatcttttgctccaccttttaatgaaactaaattaaaagataccttatttaagatttcccttaatactcttgccattaatttatttgcatttcctctttctaaatgaatttcagctcctgaatgtcctccagctaatcctttaacttcaatcacatattcttttgtattttcttttttatttgtccattcaataggcaaagtagattcagttctaattccaccagcacagcttacccaaagttttccttcttcttctgaatctaaattcaaaacgatttttccatctaaatcttttgattgtacagctttagctccagtcattcctgtttcttcatctgttgttattaatacctctatagcaggatgttctatcgatgtgtcctctaatattgccatcgcataagcaacagcaattccatcatctcctccaagagttgtattatccgcatatatataatcatctttgaccactaaacttattggatctttttcaaaatcatgaattttatcgttatttttctcacacaccatatccatatgaccttgtattataactgttggagctttctcatacccttttgatgcaggttttttaataataacatttagggcatcatcttgaatacattctaatcctaaactctttccaaagctcaataaataatcacttatttgcttctcatttccagaacctcttggtatcttacttatttcattaaaatgataaaaaattcttttccccgtaatattctctaaatttttcattctactctcttcctttcatcaattatatgatagaatatgattatacatatcttttcttagtttatcataaaatattgctatattatgtatatttttattattttatgattaattatttcacacactataatatatatacaaaattttaatgtgaggtgtttatatgcaaaaaacaaaaatgatttttactattggtccagcaagcgataatgaggagactttaagaaagttcattgaaattgggatgagcgctgcaagattaaacttttctcatggtacacatgaaacacacaaagaaaaaatcgaactaatccaacgcctaagtaaagaaatgaattctgcaacagctatagttcttgatattaaaggtccaaaaatcagaactcataactttgtaaacgatggtgtaactcttaatgacggtgacgatttcgatttcatatgtggtgaagaaattcttggtgatgagaaaagatgctcaatctcatatgatgtactttatcaagatataaaagttggcggaaaaattcttgttgatgatggccttctaaaatttaaagttactggtgttgaaggcaaaacaattcatacaaaagttgttgtaggtggtgaaattaaaaatcataagggcgtaaatgtacctaatgtagttattaaattaccatcaattacagaaaaagatatagaagatataaaattcggatgcaaaatgggcgttgattttattgctgcatctttcataagaaaagccagtgatatcttagatgtaaagaaagttctaaaagaaaaccatggggaacatataaaagtaatagctaaaatcgaaaaccaagaaggtgtagataatatagattctatcatcgaagtaactgacgctgtaatggttgccagaggagatatgggtgttgaaattccaattcaaaaagtgcctataatacaaaaaatgataattagaaaatgtaatgaagctggtaaagttgttataactgcaactcaaatgcttgattcaatgattagaaattcacttccaactagagctgaagctagtgatatttgtaacgctatttttgatggaactgatgcaatcatgttaagtggagaaagtgcttctggttgtttccctatagaagcagcaaagacaatgtcaaaaattgctcaagaagctgaagaatacttagattataatcacttaactgcaagacttagagaaccatcacttactgactacgcagctgcaataagttattcagcatgtagaacagctaacatcttacatgcaaaagctatagtggcagcaacaaagagcggtgctactgcaagactactttcaagatacagatcaaaggctccaatcatagctataacaccttacgaacaagtaagaaaaggattaagcttaaactttggaatcttcccaatgccttgtaaaatgtttaactcaacagatgaaatattaacagaagctaaaaacacagtatttagtctaaatttcacacaaccaggagacgatataatagttgctgcaggaatgccaacaactcaaactggcggaactaatatgttaaaaatagaaaagatttaatcaaaacattcaaaataaaacaagtatggattattatccatacttgtttttcatatttaaacttctgttaatctactcaaatttgaaccctttaagtaagtctcccaaggaagttccactttcatcactgttgtcaatgtaatcaagatattctttattagtttctacagcttcctttatactcaatgctattcttttttcttccctattaacacttagcaccttaacttttactttttgattcgcttctaatacatctgaaggctttgcaatatgttcgtctgtaatctctgttatatgaactaagccttctatgccatcaaataactcaacaaacgcaccaaatgtagtaagacgtataacctttccttcaaatatatcgccttcattaatgtctttaccatgaactgtccatggctctttagttacatcttttaatattaatgaaagtctttcattttttctatctacattgcctataaaaacttctacattatctccctctttaactatatcttccggcttatttactctttcccatgataaatctgaaaggtgaattaatccttctactcctccaatatcaacaaaagctccaaacttaactattttcttaacaactccgtttcttttctctccctcttttaaattatcccatatatttttcttatttttattatattcttcttcttcaataattcttcttgatgctataacttttttattcttaaagtctaattcagtaattctaacatctaaatctcttcctactaaactactaagctcaattctttctctgcttgcaagagaacctggaataaacactcttacgttaccatagtatgcaattactccacccttagtttcttctttcacatgtactttaatattctttttttctttgaaacattcacttaactcttctctatcctttatttctaaagcttttattaaagaaagttcaacatacccctcaccatcattgggagatatgacataaacataaatttcatcatctttactgactacttccatcggatccctgtcatctatagatacctcttctttagctattaatccatcgaaagcataatctatattaaccgaaacctccttatcgtttacatctataaccttaccttttaatacatctcctctatttagtctttttacatcatattgatttaaaagttcgctcatattgctttctaattcttcattggacatagtataattcactcctcattataatttttcttacttacaataatagtctaatagaatcttttacacaagtacggtttactgtgctacaaatataattataatataatcattttaaatttaatcctcatattatcttaatataaaaatccatattgttttaatctaattattcccaaaattatttgcaatttcattatacagtatcaaataccatttaaaaagatataaaataactattataagagagagataataacctttattacgatatacaattataatcatcctttttagtcttttttcatcgcttttccatattgtgtataaggaatcttttttatataataagtacataatcttttaaggggtgatcactattcgtaagattaaaaaaaaatatgttttaactatatttttaacattcatatttatattttctaatttatctttagatgctatgtcatttataggtataaatacatctaacaatactacagtcgcctttgctaaatcaactggtagtagcagtcgatcaagctccagcggcagcaaatttagttctggcagttcaaaatcaagtaatggatttagttcgggatcttttagtggatcaagttcttctagtaaatcctcaacaaacacaagtggtgattcaagtagttcaaagagtggtgaaggatttaaatctggtaatttttcgaatagtgattcttcaaactcaaattcaaagaattcttcttcatcttcaagtagtggtggatcacaaggatttagtagcggttcttattctacaactgataaaagtagaaccactgacccttcaacttcttctaatacaaatgataataaaaatactaatactcaaacatataatagtggttccaacagacattcattctggccattctttggtggtggatacttttatagaccattttattttggttcaccagcaagttcattaattaacaccttagttttagctggagtattcgtactagctattatattaataaaaaaatatttaaataataaaagaaaataaaaattatttggaggtataggcatgggaattttttcaaggatgtcaaatatgattaaggcaaaagtaaacaactcattagatgaaatggaaaatccagttgaattattagaccaaaaactaagagatatggatgaacaattcaataaagcaaaattaagttcagctcaaattttaggtaatgttcatgaaattgagaaaaaactagattctgctaaaaaggaatctgaagattatgatcaaaaagttagattagcactaagcaaaggaaatgaagaattagctaaaagagcattagctaaaaaagttgaaacagataaaaaggctgcttctctacaagcaagctatgataatgctaaaatacaagcagatactttaaaggcaaacttacgtgctttagaagaagaaataacaaaaactaggagttacagagatgaggcagctgcaagatttgcaaatgctgaggcttctcaaaaagttaatgaagttcttgctaatgttcaaactaaaaataactcaatacaaattgatagtatagaaagaaaaattcaacgtaaagaatctcttgctcaaggtttaggtgaattaagagacctagatgattttgatagcgaatttaagaaattagatgaagttgatttggatcttgaattagcaaaatataaatctaattaggtgataaaacatggataatgataaggatctaaattttattaacgaagaacgaaggtattggggcaaaatttatacagatataacttatgctataagtgaaatatccccatttatttcagaaagagattcaaagataagaaaatatttctctaaatcacctattcttaaggactatatgaagcttttagattctgctgaagctgattgcaagaaaaaatccttattttcaatgtttaaatctagtcctagcataaacttacttcaagattttaaagctaaaaatagagaaaactttaaacagttagaaaaatgctctcattgtgaatgcttgagttgtgcatttgattgtaatttcaaaaaatgttcaagctgtagaagcggttctctaatttgctcctgtgataaagaaagagtcaatgtaagaaaatttgataattttatgctagaacttactaacaacgataccggtatctcttcaaaatataatgttttagctgtcgttgaagactgtactttagataatttgtatattcttctagaaaatttcaacaactctaatgataagctagtactatactattaccctggaataaaagaagatagttacggagagataactgatcccaacgaatttgattttgtagtagaaacttatcaaaatgcagagtagtactattaaaaatctattatctaataatatagaagttatagttcaaaattgatttataaaagcaaatctttctcagaataaaatggagatacgtatctttatgataaagatacgtatctccatttttactagttactcataagtttaaattttcaaaatgaatatgattcgtatatctataatactttaaccttcatcatacattgaaaattgttgtatttctaattcttttctcttttccatctcattgaaacaataatttattatatcacttctttttattatccctataaaagtaccatcatcatctgttacaggcacaaaattttgacttacagctaacgatattaagctttctatatttgaagttatagaaacagacctatgagttgtttttctataaatgtctttaactttaacagattctatgtttttaaaattcaaattatgtgtattttttagcttccacaataaatctccttctgttagcgttccaacatattttccttctctatctataataggaatagctgtatatccgtagcattccattttctccataacttgtttcatagttgcatcttgattttcacatataacttcatttttgggtgtaagaaaaaaggctatattcataaataaaatcctttcattcaatgtattcgttttgttcttcttcacaaaactattttatcatatctcggattaaatttctttaactaaattcttacttatttctgaatatatactgaaatcacctttttttctcactattctctaacttatagatataatttaagtacgcttcatctttcaatacactattaacttcgttatatccattctctccttgaagagtctttttaaccagaacttcgcataagacattgcacttacatttcggacaagtgcctacagctgcaaatctccaatttaaaagctttataggagtttgtaaatcaattttttttccacacttaggacactttagcattaatttttcttcttttatttttatactctcaagatctgatacctgtatggcaggcatattatatatatctttaactatataattttttatcactctagaattatatactcttctaaatacctctacggtatattttgcatcatttaaagcatcatgtaattttgtatcatctactttaattttcaattcatctaaagctgacttaagccccaatgcttttttatgagctaaaattttagtaacatattcttgaatatcgagatattcatttaaccatcttaaatcattataattataatgatgggcgttaataattaattctgcaacgtcatcctttgcccatgaacataaaacatctccatcttcaaacatatcctttaatttacttatagcttcttcaaaagatactcctttttcattaagtatatccatatctattttagtgatttctgttactattggattaattaccggaaatattttaggcttaatatattccctaatttcttttataggtttcatatatttatctacttttactgcacctatttctataatttcattttccaaacttattgaatcaaactcgccatatttttcaaaaaaatctttttgataattagttatattttttaaattattaaattctaagtcaataataatgtaccccatgcttaatcctttctaatgctaatttttaattctttaaactcaattatttatacttctatccctgcaagcttcattaaatgaattgcattttgtgttgtacttcttccttctctaagaatatagtcaaatttgattttattattttcataaaattctctaaaattataatttattatctcttcactttcattttctaaatcacataattcaaagtcatgagtagaaacaagcccaacccctccgtatttaattaattgtttaatcaatacagatgcaccagtatgcctatctcttgaattagttcccttaaatatttcgtctagtagaaaaaatacactttctcctcttttacatgcctctattaatatttttattcttaaaatttctgcataaaatgacgaaatattctcttctaaattatcttttgttctcatgcaagtgtatatcttcataattccacaagaaaatttatccgcatgcactggtgctccgatgtaacttaaaaccagattagtaccaagtgttcttaaaaatgtactttttccagacatattggaacccgtgattaaagaaaccttttgattacaagtcatcaaaaatgtattttcaactgctttttctcctaataaaggatgacctatattcactgcagttatttcatttttatctaaaataacaggatacgtccaattttcattttcaaatggcaaattacatacactaactaatgcatctattttatgcattacttctaaccaacctttaagtttattcccattcttttctctccatttttctaaacttcttaataggaatacatcagaaaataatagtatattaaataacagataatatgcattatatgaactatttcctatccaatccaagatattagaaaaagctttcatctcttccttacaacttaatttatcacttttcaactttccttgtaaattctttaaatattgtgaatcaaaattttcttcttctattagaaataaaattttactatacccatatatgctattttttatggattcaaataatttaatctctgtacccatgcttttagataacactttaacaacgataaagttcaccataagatttaaaagtagaaatgattgtggtattacctttaccattgctaaatatatcgagaaaattgttactaaaataaaagtacatgcaataacaattctcagcggacttgatgattctgtccctccactccaattaattaagttatctaagtctatatcttttgattttttcaaactgccctcaagaactaaattttgcctccagacagctttactactcaattcctttacagcttcttgtctttcagcaatatcaagcttattcaaattcccttcattttttaataattttactagttcttctcttcctcctttagttactgtatcattaatatattgaaaaatcgagttattgccaaatacgtccaaatcatctataaatggatgcttatagtccaaatactctgaaccagaatcctcgaaactcgtaaaattgccacttaatctttttattcccttctcattaattttcattatcgtatttatcttttctctgtattgaattatattattgtgataaaatatcaaaacaataaagataccaataaaaaatatagttgagatcaatattagatttaatttattctgactatataaaatataatcagttaatacccctaaaatcactacaaacaacctgctccatccaataattttcaccttatagttcaggtcttttgtttgtcttaaacatcgttgtatgttctctttataaaattcttctgctaaactcataattcctcctaacataataattttatttttataatcaatctttttgttgactataaactaaacttcgtaatttaaacaaaactcaaataattaatataaattaaactattgttccaattctatatcacaaataaaataaagcacattaagatatcttatttttaattcaggatattttaatctaccttgttatcttgtgcaatctattttattattacctcatatccattttagctgtatatagtgagtaattcatatataaaatacatattccataagtataatattaccataataaattcgatttatattcctttgtttaaattattttttcattaaacttatagatattattaaaacactaagataatttttttatttaagtcagagacgtctatctaatatgtgattttattaactccaaggattaaaattaaaaggattatttccaatataaccttgaaaataatcctcaatctttattaaagttaatctagtctattctttagataagcacttgtatatctcatccaaattgtatctcatagcttctatataatttttgtcatcttcttttgattctaatgtaagtattggaactacatcagcttgaacttcttttgctaaagtttccgaaactttagggctcgctaacgactctgaaaaaacagtctttatattattatctttacaaaaacttactaagtcttttaattgcttaggagttggctcaccctctgcaaataaattttctactgatttttgagttaatccgaagtctctgcataaatatccaaatgcagcgtgacctgttatgaaatttttcttacttaatgtatcaaatttgggtttatattcactatataaactctctaattcctctttaaatttattgtagttttcttcataataatccttatttttctcatctaactttactagtgtatcttttatattacttgactggatttcagcattttttaaacttagccaagcatgtggatcaaccgcatccccctcttgcctggtttctataccagtacttgaatctacaacaattacattagtattcttaatagcttcatttacttgacctacccattcttccatgcctaagccattataaataaacgcattactctttgttaattcctgaaagtctttggttttaggctcataatcatgtggctccatattatcaggaactagacatataacatcggctttatcaccagctatcttctctgcgaattcttttaatggatatattgaaactgcaatttttaatttatcttcagttttgttttgtattccagtatttgcattagctccacatccgattagcataaaacttactaataccgctagcgctcccgaaattattttcttcttcatattatacctccagtttgcatctgatttgcatttgcaactctgtttataatattactgttaaagtttaaatatgtcaagattagttaaatattaatttaggatagtattatcaattcaaattaattaaattataatcatacttatttctatcaagaataatcttttctattttttgacatgtaaagaaaattacttgctcaaaattttcatccataagaagatttagtgcccgctctcttctctcatcatcatattggacaagagcatcatctaaaaatattgggattcttttatttttaaacaacatatttataaatgataaccttaatgctaaatacagttgatccttagcaccattgcttagtatttccccttcgaatagcattcctttatttctaatctttagcttatagtcttctgatatcttagcttcttcgtaatcatcatttgttaagaaattaaatttctttataattttcttattcatatctggtccaatattcttttttatctcatcaaatgcttcttgaatcaaattactagctaactctaatgctttaaattctttctccaactttttagttttttcttcattcattaatatttcttcttctatctctgaaatttcccttttacctaaataccttttttctataagatgttctaaatcctttatctccttctcgattttcaacaattcattagacttcgctctaatctctgagtctatttcttcttcagattcataagaatagtttatgtcctgactaataatttgtttcatttcttcctttatttcatctatatttctatcttttattaaaaccttatatgtttcctctacacttttcaatgcacttttaatttcattcattttatttattttttctttatactctctcaacttaacatgcatatctactatttctatattttctaatccaagtacatgagttttttttcttatctcatcatctttatcagctaattgttcatttatattttctatatccttattaattgtattaatctcgtattcctttataagtatttcttctttttgtttttcatagaattccaattgttctagcacctcatctaaagacttgcatcctaaaacattatacaaagatgctatcacacctttatttctattataatttgattttaatttagtaatatcgtatctgttaatctcctcttccttattttttattaataaaatcatattatctttataatctatatacttatcatattgatttatcttactaataaaatcttcataagatactgaattagttttgtttatataaacatctaatcttttttcatattcttctattctttcttttagctcatcaattgatatattatttttcctaaaaatctctgaacttttaattaataaggaatatttgaaatatactattcctattataataaatataggtataaatataatcataatgggaattatttgcttcaacatactgtatataaaagcagaaatgcaaattgctccaataaaataaatacaatttatttttttatttaagctatttaagtctccttccgacttactataatcctgattctccattttatattttaattcctttaatccttctttataagaattaagtaatctctctatttcttctctattattttttataaaatctaagttactaatgctagaagcctgcttgcttatattcatcttgaatccagctattgaattttttatatttatgatatcattaagtttttcttctaaattcctctggtcaacttttaatgtatatattttttcttttatattacttcccatcgaagaaaaaactttataatttatcattttttcgttttttactcttaattcttcttctgatttataaagtttatttaacttttcttgttttacgtctaataaacttagatatctagcacacctttcattaatttcatccaaatattcagctgttatatattcctcaccctttttaagttcttcgattattgcatcctgttttcttttaagctgctcccctttaactaaatagctacttatttctttgtagtctttttgaagttttatcttcttaatgtactttttatataaatctagcttttgaatttgttcttttatgttgcttttaacatctttcttccttaataagttttcctcattttgcacgttttcttcagctaatttatatgcttcccataactctgtttttagtgaattatttttctcttttaataaatcaatctctccaccttttcttattcctagcaattgcttcttcttcttttctaatttctcaattactttttttacagaagtattttcatctccaacattgtaaacattggttagcttctccattatttcttcttctttatctttggatataactactcctaattgtcctataaataacgtctttataaaagtagataaatttatatcgaagaaataccttcccggctcatttttatattctatttgcaagctctctcccgttatttcatctaagatttcgcattcatcttctttttttgttataccaaatcttctttttataatgtagctttttccttcatgttctattattaattctccagaaatattctctccagatagaggcatgtatctttttctatcgtttagtttacttctagaattttcaatcccatacagccatatcttgataaaattctcaattgaactttttcccttttcgttttttccataaattaaattgaatcctctgcttaaatctaggcttttatctttaatccctgcaaaagcttttatatttatttttttaactatcaaaagctttcacctctttcataaaatttacttgaatacaatttctttcgatactattttcgaatgtattaattctataatttataaatctctctttaatcaatttacatctcattaattcttacctcttcacctgagatgctttgaattcctatctttaaagccaaagaaataatttctctatcttcctccgttgtaacattctgtagctcttcatatattttttttgcaaatatgctttttaatgagtacccttttatcaattcggttatatctaacttaatttcacttttgtcaataatcttcacaaaatagaattcatctttaagtagttcttcaagtaattcttcacttaatgaaaattcatcagatatttgcccttttaaaataatcttataaaaattattctttctatcatccttaggtatttctgatataattctattttttacttcgttatatccaaagcacccgtcaatatttattcccttctcatagtaatttcttactgatgttctaataaaccggctttctacaaatctattcttaatctctaataatactattcctttatcttcaagctcatcaaacccccttccttgagggcatccgctataactgtaatatgtgttacctatcttcttaacttccgaaaacttatgtctatgtcctagtgctatataatccaaatcgcttttaattatatcttcttccataattggattgtaattatttccttcttttacactagaaacttctccatgtataaccattatgttgttatatccgttgattctttcaacatcttttaacaaggatttactgacatgtgtggtattaaacccagctccccaaacaacagtctttaaatcctctaatattactttttcaacacttcctttaaaaatatgaacattacttggccaatctacaatgctatagaaagatttttcattaaaaggatcatgatttccaggacttataaaaacttttaccttgctaatattttcaaaacagctttttataaaatgaagtgtagttttctttacagataaattatcaaatacatctcctgctattagtaaaatatctatttcttcatttaaagttattagcattatgttctcaaaaacttgttttaattcttctttactctttagtgctagctttggtgtcattccactaaaaggagtatcaaaatgtatatctgctatatgtaaaatcttaatttttctcatactatcacacctaaacttttttatataacgaacttttgttctaattttaccacgaaatttgcgaacagtccaaaatgattattatgcacgtttataattcaaacctctatataatatttgctcaaaaaacaggagatgtattatacctttgtataatacatctcctgttttttagaatatgattagattatcctaacatacatagaaacaatattaaattataaaatttcattagattctatgttcatattcttctaccattctttttaccatttctccgcctactgaaccacattgtctagaactcaagttaccattgtattctttaaatggtattcctagttcttgagccacttcgtccttgaatttttccaagccacgtcttgcttctggaactaatgtcctattattgttgtttgacataacgatcccctcctcggctaattgatagaatcagtaaacaaaactctaaaaattttatctaccgataatagtattttaaccttacgattatttattattctcattaatataaggacattcttcaatatttatcctctattaaatattaaaatagaaatctctactcaatataaatttatcgattttactattgcactactaaattcaatttattctatacaactatctctttaaatgttgtttctatatctctttttatatcagtaaatatatcactcttatctttaataaaagaatttagcaaatcaattgttattgaattaaattcaataatatctttatctgtaattaaatcatcagccttgcctctttgtaaatacttattcatatccttaaagaatctatacacttcatctttaattaaatcctttgacattaagtcttctttcatatttaataatctttttctaatatctaatgcttttaatggaaatagtaaatacatatttttttcgcttaattgcttaaaatcatatttccatcctttgattatattaattgtataatctagatttttttccttagcttctgatttaattggatacacatcaggaacttcaatattggaattcaatattatcatggatttagaatacttatgcttcaaagcatattcacttttatttacacttttcctcttttttgcattaaggcttattacattgtgattattcgataaatttaccttagttatcattattgctatattttcagcatcgttaacgtgaaactgtaccctgtattcaaacttcctatactcatcttctgctagtatcttcaaatcataatttgaatcttctaacttaatatcttcatttatatctatatttttttaatcttattatatttcattctcgcatccatatttaaatcgtcattatataatgaatttacaagctcaattattgttgtattatttaacaaaaaaattctctcaataattttatttaggttctttataccaccattcttattgaattcctcattatatcttattttcgagttattagcttcatcatcttctttgaagcaattaaacttctctctaaaagatatataggacttattgctttctttttcattaatagtattattagttgattttgccaatctatttttattctctattcctttttttctaacttcgtttagcaaaactaatttattcatatcgtattccacctcacaatggattattaccataatatgtcttcaatattcaaatattgaatgtattttataatagctcattcacaagacacaaaatagtttttataaatacataattatttatgtttacatatagttcattatattaataaaattatatactttttctgggaaaggtcaagttattttctacattttatactaaattattctctttttacttatttttagctaattatttacacggatatacaaaccaatcagatgcatttctgtaactctaaaatatactttttttataagccatacatttttgtacataaaaaagccgtagtacaacgtactacgacctttgtggcaggggcagtaggatttgaacccacaaccaatggttttggagaccactactctaccgttgagccatacccctaagacattaagtattgtatcatgtgtttatcatttatgtcaacaattttattattttaatttttagtaatcattcaaatcaataaattattataataatcttaacaccccaatgcaccaaacaaacttaactaaatagtagtttttttaaatacttcttgtttaactactcatattattttataataaaatataatactttgatagtcaaaatattttattgtcgaatttttcgtgaaaggatatatgtaaaatgaattttaattctcttaaaattggaaatttagttgctcctattcctattattcaagggggtatgggaattggtgtttcatcttctaatttagctgctgctgttgctaatgctggtggaattggaatcatctctgctgcacaacttggttataatgaagatgactttgaaaagaaccctttagaggcgaatttaagggctttaaaaaaacatattactattgctaaagctaaagcagtaaatggcattataggtattaatgctatggtagcaactaataattatgaagatcatataaaaactgcaatagaagctggagttgatttaataatctctggtgcaggacttcctactatgttacctaaaatagtaaagaattcctctgtaaagattgcaccaatagtttcttctttaaaagcagcaaaagtaattttgaaactttgggataagcacgataatgtagctccagatcttgttgtaattgagggaccaaaagccggcggtcatttgggctttaaagttgaagagttagaagatgaaaatttagattttgataaatctgttgtagatataataaatgaaacaaagaagtacgctgaaaagtataataaagaaatcccagtagtagttgctggcggtgtttttgatggatatgatattgctaaatatttaaaattaggtgctagcggcgttcaaatggcaacgagatttgtagcaactgaagaatgtgatgcttcggatgagtttaaaaatgcctatgttaattgtaacaaagatgatattcaaatagtaaaaagtcccgttggaatgccaggtagagctatgaagaatacatttgtaaagaaaactagctctgagagagagaaaataactcattgttataattgtttaacaccttgcaaccctgctaatacaccttattgtataagcaaagctttaataaatgcagtaaagggtaaccttgatgaaggtctcatattctgtggtgaaaatgcaagcagaataacaaaaatcacaacagtgaaagagcttatggatgaattagtatctgaaattaagaaagcttaaaaaatagactatttcaaagaacttccttatcacgaggatatctttgagatagtctattttatttacaataatattattttagcatttcatctataaactatacatttttgaaagctattacttcaacctcgcataatactcctttaggaagctcctttacggcaacgcatgaacgtgctggattactaacaaaatacttagcatatacttcattaaagctagcaaaatcactcatatttgcaataaagcaagtagtcttaattacattttcaaaattaatatcattagcttctaatatagctgatatatttttcattacttgagttgcctgctcttttatattacttcctacaacctcaccagttgatggatccaacggtatttgtcctgatgtaaataatatatttccaaatcctattgcctgagaatatggtccaattgctgctggtgccttttttgtatttgttacttctaacattttataatccctccaaatcaaaattaagttatattaatttactttttattaataccatcattatttatatctattgatttaaattcatatctctaatagggaaaattaagtattataaatacggatttccttatgatcctaattctttgttgttgtaatcaaatttttttatataaaaaaatcgtagtacaatgtactacgatttttgtggcaggggcagtaggatttgaacccacaaccaatggttttggagaccactactctaccgttgagccatacccctaagacaataatcattatataacatatctataaagaaagcaacatatttttataattaattatcgtgaaaataaaactacactaaatataaaatactttatatttatattcaaaatttgcaaattctttagtgcagtatataatcacatctaataataaaaagatatataactccaaaataagtaattctattttgcattactggaatttacgacttcattgggtttagcccattttgataattcttttatattgtataaaatcaaatcatcaaaagacatatctccataatatttccacaactttatagtattataacctgacaaatctaatttcgttcctttttcaccatcaactattattattatctttttaggatctaaattattaatttttatgaactcacttaactcatgattatcaagctgaatagtgtttaaatttaaagacttagttaagtaatcaaaatcattatttaatgtaataaatttatattcacttaaggattttattttctcactatattcctttatgctagtatcaaaatttttgatagcttcattataattttcctcataataatctctattttgagggtctctatcttgaatagctgcctttacattgtataatgctattttatactcttctataccttcaaaatagtaaggattttctttagtgtcattatcatgcccataatttaataattttatgcctctagctaaatttattatcccaaggcttcctttcttcaattcactaattagtgaatcactccatggttcaaaagatgtgccagaatatataaataaatccatattggatatattatttaaaacatcttcactatatttaaattcactaatatctttctcattagtaaacatatactccgcattattcttttcctttataatttttttaaccatataatattgtggtttattaactgtcattatatttagatatttatctctgctttcagttctattattctcagtattagctaataaaggatttgaaaaaaaactcataccaaaagacaatgctatggttattatcaccatggcaaaggtaattttcttcaaagacaagtcacctccaaaatttaactgacttcatttataactttctttttaatatgtactgtaattaatttcttaagttaattattaattaacatttattaggttaaacataaaataattcactttatatatattgagttacatatgttacctcagtaattactctgttaattaaattttagcatatacctattcttattataccaactaatttaaaataaatatatacaaatttattacatttttttgaatgcttatttcctgttttatataattaaattagttaatacattattaatttgcttttatgcaattttgagataaaataaaaagatgagagtttttagatttaacaattattaggttctatacataataactatatgtaagttattgatataaaattctaattaataagaattaattctcacttaaaggaggcacttcatggaatttgaaatttataatgtagatgatactgctaaattaggaataaatttaggcaaattattaaatgccggtgatataatctgcttaactggtgatttaggtgtaggtaagactcatattacaaagggcatagctaaaggattaggcattaacgataatattactagtccaacatttactatagtgaacgaatatgatagcggtcgattaaagctcaatcatttcgatgtttatagagtaagtgatcctgatgaaatatatgcaattggatttgatgattatatattttcagatgcagtatcaataatagagtgggcaaattatatagaagaaattctaccaaatgatttacttcatatagatataaagaaagattacagcaaaggcgaagattatagaaaaatcacgctaaatgcttatggaaaaagatatgattatataaaggagttgaaaatatgattattcttgccgtagattcatcttctaaagtggcaactgctgctttgatgaaagatgataaactacttggagaaattacattaaacgataagaaagaacactctataatactaatgtctataattcaagagttgctaaacaataacaacttaagtattgatgatattgatggctatgttatttcgaagggtcccggttcatttactggacttagaataggcatggcaacaataaaaggtcttagcttgggaagtaacaagccttacattagtgtttctagtttagatgcacttgcatttagcgtatctaatttcgatggtataatatgccctataatggatgctttaagaaatagtgtttatacttcactatataaaggagaatatacttgctgcagtaacaataatgcttcaaatttacctataaaattggaatgtctattagattattcagcattggatattgatgaacttatagaaataattaaatccaaaaatgaaaaagttatttttataggcgatggtgttgataaatataaagattatttgattgataattgtccaaattcatattttcctcctaatcaccttaatttaattcgtgcctcttcattaggtgaaataggcagtgcactattaaagaacggagaatatgacgatccaaattctgctccggtttatctcaaaaaatctcaggctgaaagagaatacgagcaaaggatgagattatagtgaatatagctataaatttaatgaaagaagaagatatagatgaaattttagatataagctcgttgagcttttctatatgctggagcaaaaattcttatatgcaggaactaaccaatcctgttgctaaatattttgttgctaaagttgataataaagttgtaggatttgctggaacatggatagtattggatgaggctcatataacaaacatagcaacacatccaaactatcgaaaacaaggaatagcctctaaaatcctagaagaattactatcttattgtaaatctcaagggtgtgtagcatatactctcgaagttagaaaaagtaatgccgctgccaaagccctttatgaaaaatataactttaaacaagagggaattcgaaaagggtactatgaagataacaaggaagatgctattttaatgtggttaaaggagtaatatctcaattacaaatttctgtgcttaggtaaacatatcaaagagacaattcatgcaatcattatgttcaaattgcataaattgtctctttacacttatcatcaatttatatgcagcaaaaaactacctctaataattgatttacttatattctatatcaattcaatttcattactttctaacacatctataattggttgattaggcttttcatccgttattatagcatttatatcatcaatcattgcaaatttataattaccatctacaaaaaatttcttgttctccataactaaaaatgtctttttactcgattgtattattgtggccttagtaattccatcctcaatttcaaaagtagttatacttttatcaaaggcatcaattccacaacttcctataaaagatttatcaaatttatattttttaataaaatcattagttgaagatccaataaaaccattaagagatttatttaaaactccagatgcaactacaacagtaatattattggctgcctttgctaaaatatttgctatctccaacatattggttactacagttattcttttttgagttgttaaaatagatttagctataagaatattaattgttgataaatctaaaaatatagtttccctatcttgtattagttctaaggctttcttagcgattatgcttttagttgaaatatctatcttctctctttctgaaatgtcatacaactgcgatgattcccttatttgaatcgcacctccatacgtccttttcagctttcctgcatgctccaattgttttaaatcttttctaatacaatcttctgtcacattaaactttttgcttaaatccttaactttaacttttccatatgtatttagaatatttaatatttcgtttagtctctcttctgtaaacatatctatgcattctcccattttttattatttaggaccttgtggtaaataattaatctaaatatattataagggactttcaaaatataacaaaattattttgatagccccttatatctattgtttttaaatattttattcttatttataaattttctaaaataattatatagtcaaatttaaattaaaacaatatctactattgttctttttcaaaatctgattttggaactccacataatgggcaaacccaatcctctgggatatcttcaaattttgttcctggtgcaactccattatctggatcacctgctgcctcatcataaatataaccacatactgtacaaatatatttttccataaaaaaacctcccttagatttgataattaaatattaataaatacatatcttactatgttaatttatcatcttgtaaaatatatatcaattaagcgcttctgcatttattgtgatgagctaattagaacgatctttagtttaaaagtttctataattatatcatttttgtgacttcttgcagagttaataatttaactactacctctctctattattacttgttattccttatgatatacatttagccatctatcttgttgcatttcacatactatcataaattattgtaatctcatttttttatattcacttgatcattaaatatcttctttaatctttaaatattttctatatatataataccaaataattcattattaatcaataattattattaattaattttaattttctattatatgaatttattttataaccttttgaacaataaatattaatacatataaaaactataatatatctatctgtttaacgttaattatttatatattattataaccattatgccaaattaaatctaaattataaaatttaaaaggagaaagcactcatctttatgtgaatagttgctattaaaattttatctgatattaaatgagtaatcatctttagcttatttaataatcatgttaaaaatcaatttaatattaatgtttatatataacattaaatttatataccaaccaatatacaataaaaagctgtaacaaaattcgaattattttgttacagctttttctgcttatattattttaaaattatacaatttttgtcttattttctggactgccaaagtttggttcaaccttaaaaattgaaacagatacttttttgtatagaatatatgttaataccgacaccataaccgcctttactccattgaaagctagtaatgcccaaacataattctgtaacatatccgctggcatcttcatcccataagctggcaataataaatatatgttacccacaattcccattgcctccattgcaattccacctattatcattcctaatattgcatttttcttgttcttatttctatagtaaataaatgatgctggcaaaattaatgctgctccaaacaagaagtttgctgtctctccaacaaaacctgtttgacttcctctgattaatggaaccaaaagattttttattaattctattatcacccctgctacaggaccaaatccaaaagcacccaacaatgctggtacatcacttagatctatcttaagccatggaaacgcaggtattattggaaaatcaaaatacataagtataattgcaattgctgataataaagagattttgattagtttacttgttttttcattcatattctttgcctcccaaaagattatcttcttggtgtagcttattaggaatttagtgtcaaagtattcttagtacattagttactcctgaactattcgcaatacttaataaaaaaataaaaagccctgatgtaaaatacatcagggcatacattcagcaagtaataatagatcaactttcaattcctaataggttaccttctttcatccagactatactgtcggcctcggagttacaccgaatctgctttcttaaaagctcgcgggctataccgccggtagggatttacaccctgccctgaagatatatattttatttcctttattatataactttaatcaatactttgcaacatctatttgagcactttttatatttctaaatttttaataaaaaaagagtaagatttctatatctcaccctcgccgcaaaataattataataaaaaattaaacgtttttattataattatattattctcctataagcttatcggtttttaatatatgctctgttaaccaatcatttaaaaaattcaaaagttttattaaactttcatcttggttttcatcaatatttttataatctatttcttcaagacttttaataaatttatcatgctcaatcttttgagtaaagagtcttttatagtttatacttttcatatattcttcttctgatttaaaatgaaaaattgtataatccttcagttcgtccataatatgtattatcttatcatacttatcaattgcaaattcatcttttaacagcgtataagcttgatctgccaattcaaaaagctttttgtgttgctcatcaatctgatcaattccgattttgtattcttccttcatttcatacatgtataataccttctttctactcattattttaatcatactcggttcattttttattaatatatcatttttttaatataaagtcactacacttagtcttctattcaatagataaatttctaaatataaattgcaaattgatattatttaaccctacattttaaataatattaatagtatctgtcgctttctaaaacactctgccttttaacataactattttataaatatctaaaagaatagctcagaaaatcattaataaaaaaagatttaaagcacttaatcaataaaattaagtgctttaaatctttactgaaaattataaatttttaactttacttataacatctgcgcaatattcttttacacctgcaacaccgttgcttttataaactttattcaaatcactacctataccgctacaatctgctcctgcttgtatccattcacttatattatctttgtttactcctccagtaggcataacgctaagatctgggaatattgattttgctgcccctataaatgcctttccaacaacattacctgggaatactttgataaatcttaaacctaatttgtaagccttatttaactctgacattgtcattaatcctggaattattaatgcttttctttgatttgcataagcaattacatcttcatctatacaaggagaaacaataaaatcagaattattttcgatacatgcatctacagcatcttttgttaacacagttcctgcaccaacacaagcatttttatattcttctttcaattcttttattaactttggcgcatttggcacactcatagttacctctataattttcattccaccttcgattgctgctatacttatttcttttgcttcttcatatgttttagttctaataacagctactgccttttcttcttttaatgtattgtaaattttttcaaacattatttattacacctcatctttaatttattttatttaaaattaatctacatcattcataaaatactttattaaatacaaatatatatttcttaacgttctattttctttgcttgtcctaaatgtactaaaacatcatcatagtaaggtagtccctcattatcgccttcgacacctacaactaatgatccaactgcatttgcaaatctaacacaatcttctagtgacttaccttttaataaggccgttaaaaatcctgctgcaaatccatcgcctgcacctactgtatcaactaaagcttttggcttaatagcttcaatatcataaatatttttaccatctgaccctatagctcccttggctccttttttaactatcactttttctattcctttgttatggaaaacttttattgcctcttctatatttgtatctcccaataatatctctatttcttcatcacctattaaaagaatatcaacataaggtaaaagtttttctatatagttttttgcttcttccttagtccacatctttaatctaatatttgggtcaaatgatattataagattattctttttggctaattttactgcttctaatataacttctctattattttcagttattgaaggaaaaactcctgtaatatgaagaacttttgcattttttatatattcttcattcaatttctttgcatccattgtactagttggagatttttctctataataaaatgatctacttgatccatcagataaaacttctctaaaatatactgaagttggatatccatcaacaagttgtacttctgatgtatctatcccctcacctcttacaatctttagtatatattttccgaaatcatcatttcccaatctacttatccatccagattttaaccctaatcttgcacatcccattgcaacatttaattctgctccacctacttttcttttgaatgtgtcacaaaatattattggtcccttttcttgagggcacattgcaatcattgcatctcctatagtaattacgtccataaataaatacaccactttcactatatatttgtttttaaccttaccaaataagttggagatagatttctatattcatacttttgataaggccatttttaaattttagtcaatatttatatataattttgaatactgattatcttactaaccatcctccatcaactgctagaatatgaccattaacataatcagatgctctgcttgctaaaaacactaccgctcccattaagtcagatggttctgcccatctatctgctggtattcttccctgtatttctgcatttctttctttatctgcccttattggttcagtatttgctgtctttatgtatccaggtgctatcgcatttatttgaatatttttactcgctaattcattagcaaatgcctttgttatacctgcaactccatgtttacttgctgtatatggaggcacgaactttccaccctgaaatgataacatagacgctatatttattattttaccagagccttgtttaaccattattttagcaacttcttggcttaagaaatatacagcatttaaattaatatccataactgcgttccagtcctcttctttataatcaagaagaggtgttcttcttatagttccagcgttatttactaatatatctactttcccataagatttcatcgcagaatcaatcacatcttgccttccttctttttgtgttaaatctgctttcacgaacactgcttttctaccttctttttctatcaattctcgtgtatcatcccaattatcaccgtgggtagaaacaactaaatctgctcctgccttagctaatgcaactgcatatccttgtccaagacctgtatttcctccagtaactattgccacttttccatctaatctaaaaaagtccattgaaaactgatccaaaatgttttccattatctattctcccctttccatataaatatttccatccttacatgtattattaaattttttcaacgcacgccatcgttccgtattgcggaacaccgtttcatttattatcttaattctaatatcatcacttacaattgtcaatgatactggtataaaaataaaatttttaactttttatttgttaaaattaaaattaaacattacaatgtagtataaagataaaactatttaggaggattttatatgtcagaggatttaagcaatccaaacttagttcaatcggtggaacgtgctcttgatatacttgattgcttagccgaatatccaaaaggatgtggaattgctgaattgtcaaaaaatttaggtttaagcaagagtaccatacatagaataattacaactttaaaatataaagaatatgttacgcaaaatgcagaaaacgataaatatcaattaggaattaagcttcttaacttatcttcttctataacaaatagtatggatttaataaatgtcgccagacctcatatatatgactttgctaataagtttgatgaagtcatacatctttgtattcctgacgagtcatttactaacataatttatgtagataaagtatcttccgaaaatactagtagaaatataataatgtcttctagtataggaaaaaaagcgcctatttattgtactgcttctggtaaattgatattatctcaatattctgatgataaaataagagaattattaaaagatacagaattcataaaatatgcagagaacacaataactgatataaatgttcttatagaagaaattcatgttataagaaagaacctatatgcattagacaatattgaatacgatacgggtgttatatgcatagctgttcctatttttgatagaaccaataaaattattgctgcaaccagtctctcatccgtaacactctttaatactatggatgatttactaaaatacaaagaggaatttatgaatgtcgctaaaaatattagtagacttatgggatatgcatattatacagatataaaataaattttttgaataaaaaattaataaatttcaaatataaaaaggctgaaattgaaataaattacatacatttgcttaagtttataaataaacattacacaaatatatgtaattcatttctatttcacgtaaattaaataacatgagttaaacttaaatttttttatacttattatctatgcttatacatctctaaaaaagcattttatgaaagttctaaataaaacggccataaaacattttctttatttcttgttaataacatattttatcagtgcttctgctaccccatcttcatcattagttaaggttacatcatcagcatgtttcttcacatcttctggagcatttcccatcgctactccaactcctgcatactctaacatatcaatgtcgttataattgtctcccattgctattatttctgatttatctatactgaatttcttttgtaaacaggtaattgcagatgtttttgatgcctttataggcataatttctaagtatgttggctttgaaggatatatatttaaatcattatcataaatattttcttttaagaagtttatttcttttggattagacatacataaaatcttacttggtcctactccttctcttttccattgttctattaatttattaaaatcaataatattaggaatgatgttagttatttcactttcttgtttagcccaataatctaatttttctatataccattcatcatccttatataaactcatatgaatgttattttcacttgttaacttatatattttctcaaaattagaaacatcaattgcctctctagccaatacactattatctttatctaagattaaagcaccactatagcatataattggttcctctattccaagttcttcttgaagaaaccttattccttttggcattctagctgagactaaaattacaggtattttcttattatttgcaactttatttatagtgcttttcaccttttcagttacttcatgatttgaatttaacaaggttccatcaatatccaagcagaccattctaatttttttcatttattcatcccccaactatttataataaaacgtcaaactacttataattacttatggcattgaatatttataagcaaataaaactcaattttattctcctaaataacactacttaaattaatatgttttctttatataatcactagacttttaggattaatttcaatattatgcaattccataatgttactaaaagaagaaaccgatattggatcaacaataataatatctgcccgatctaggtttaatcctttataaaaggcatctttttcatacttttgatgttcggcaagtaaaataaccttcttagctcttttcacaatctcccctttaatataagcatcttcttcattttcataataaataccattaccttttatagctccagctcctataaatgccgcctgaaactctattccgctcaaatactcatcataattccttctatagaaaaagcgatttttcttgttaaattttccatcaatcaagtttactacaataccattcttttccgaaagtatattaaaattatctatggaatgagtaaatatggtcgcttttttatctaaagatcttgaaagaaattcaatactagtagaaacatcaaaaaaatacgttttattgttatgaataaatttcattgccttttcaacaatcttagttttttcattaacatttaatttcaacctctccttatatgaaaatatattatctttattaagattttcatatccttctttctcaatcataaaatcaccccctataagcaattataagcatatgtagttattttttcaatacttataagtatttttaatcatcactcgcctaaaataccttatataataattatttttatctttaaaacacttcttaaatacttttaaaaactatcaaaattaatttaaatgttaattatttgcacactacaactttacttaaaacaacattctttatttatcgtaaataaaaaagcaaatctttataaatagtttattatttataaagactcgctcacctatatattattaaatcatgttatttttcaagttatattttataatccttctcaattttaagaagcttttcctttatattaaggccaccagcatatccaaccaatttaccattagcaccaattactctatgacaaggtattataattggaattggatttttattattagccaaaccaacagctctcgccgctttctcattgcctactattttagcaatttcaccataactccttgtttctccaaaaggaatctcttgtagcgcactccatacttttctttggaactccgtacccttaggcgctaatggtaaatcaaaacaattccgctctccttcaaaaaactcttccaattgttttatagcttttcgtagtaactctgtttcatttccttctatgttaagttcgtctttgtttatgaaacaaatttttataattgctgtcccattttccactatgctgatttttccgattttagtgttataataatatacattttccataatacacttccttttcgcaatattatttttttctactacaattagaataggcgattcttcacatgcacacttttccacttcaaaagcatacattttaaaaaactttcactaaaaaatcagtatcataaccccaatgtcgcatctattgctacactcctattcttcaaaattctttaattatatagtgggaaatcatgcttatgtcgctaacatacctgaacatactttttattatctccatataaaaactaatgtctttaattagactagaaactttgttacttaatatcttaacataaaactctattttatagtatctaatacagttctcctaacttatctctatctaaaattttcataatctcaaaaactatgatagaatcatatattttattctatcatataaaaaaggatgaatataattatatacccatcctaaaactatttttctatttaaaagctttcttataaatttctaaaatttctaccacacttgtatctcttggattacctggagtacaagcatcaacaaatgctgattctgcaagtgattgtaaatcttcttcttttacaccaatttcatttaacactttaggaattcctacatcttctgaaagctttttaactgcgtcaatagctgcctttctatattctttttgagacatattgtctacaccttcaacacccattacccttgctatttctctaaactttttatctgttgcctctgcgttgtactccataacatatggcaataatactgcattagcaattccatgtggtgtatcatagaacgctccaagcggatgtgccatcgagtggacaattccaagtccaacattactgaaccccatacctgcaatatattgtccaagggccatgtcttctcttcccttcggctcattatttactgcacttctaagagaacgtccaattatctcaatagctttcaaatgtaatgtatcagttaattcccaagcgccttttgtaatgtatccttcaatagcatgagttaaagcatccatgcctgtagctgctgttaatccttttggcattgacgacatcatttctgaatcaacaactgctattactggaatatcatgaggatcaacacaaacaaatttacgtttcctttcctcatcagtaattacatagttaattgttacctctgctgcagttcccgctgtagttggaactgctattatatcaacacatttatttttagtttctactgccccctctaaacttcttacatctgaaaattctggattattaacaataattccaatagcttttgcagtattatcaattgatgatcctccacctattgcaatcaaataatctgctccagatgcttggaatctctctataccagctaaaactacatttatagttggattcgctttcacttcatcaaaaatttcaaaaatcaaatcattttcatctaataaatttgtaactttagatgctacattaaattttattaagtccttatctgttacaactagtgctttcttatagcctcttattttagcttcagtaacaatattttcaattgctcctgctcctatatagcttgtctcatttaatatcattctatttgtcataaatatcaattctcctttaataattttgataactgtataatgtatccaccgaattttatataataataatttatcagcaaagtgcaatctcatatttataatttataaatcgttttcaatttatattgtagttaactatttttataatactaactgtttatatacatataaaaatcatatctatatctatcattattaaacaatctagttactatacataatataacaactagattgtttccatattatgatatatataataagttgtctgagactaattttatacggagatagggttatacttaagctaattttcactctagtctcaaaataactttattaaactaagtaatcttcagaaatactaacattaaagtcttttgctaaatctctaaaattttcagaaacaattgtttgtttctttccacccattgatagaactttaactaaaatctcagctgatttctctactgtatccatcaatccaaaagttagatctaatgtttcacctgaacaaaacattccatgatgcgcccaaattacaacatcatgatccttcattagttcaccagtagcttctgcaattgcagctccacctggaaccatccaaggaactaccccaatcccacttggaaatactacagggcattctgttgccatttcccacaattctcttgtaaatactttttcttctaatggcaatacaaacgttaatgcaattacatttgtagtatgagaatgcattataactctatgacatccatttgttttttctacttttattgagtgactcattaaatgtgaaggaagttcgcttgttggtcttgcattatttgacaatccccaaactaccttatagttttctcccttttcatctattttgattattcctgcattttctcctaaacaaactgtcatatttcttataaactttccacttccggttactaagaaatattcattggctaaattttttacagttacaccaattgaattatattccgaatcttcgttgataaattctttaattgcagaaacttcttcttttgttaatctataagttatatttccaccatttctttcatgccatcctttaagccacgcatcatttgtcatcctcttaaaattttgtataaacttcatatcttctattgtcatactttctcctgctttcatatatttattatgtattttaacatttggtccattttaaataattctattttgtaaatgtatgtaactttattcaccgattaaagatacaaactaatcattttaattccagattaattttatcttataaataaattatacttcattcttttgttaatttcaattgctttttgttgtttttatttgtttttatttgtattaatattttaaaaacaacatatccttatagagctttattaaagtatattaagatctgctaaaactagcatttataactaatttattagcatttttatcaaaaaataaagaatcacctatttattttaagtgattctacaaccttttctatatgtacatcaatatataacctcaacattattagcatgcagtaaattaatccattcttcatttggttcaatatctgttatcaaatagtctatgtcttcataatcaaaaagctttacaaatgatgttttatcatatttactatgatccactaacaaaatgactttattagattgtttgatcatagatcttttaatttctgcctctgtctcattcgagtctaatattcctttatttatatccattcctttacagcttacaaatgctatgtccacattataatttttaatagcattttgtgttattggtccttgtaacgacaaagttctttgatccaagccaccaccagttgatataatattcaactccgattggtttaactcttgtaatacttccactgaatttgttattacagttacatcatttctatttctaattaatttcaatgcctcaaatactgttgaactacaatcagcgacaatcgtactacttcccttaacaaactctatagcctttaatgctatatattgtttactttctatatttgtcctagatcttttataaaaaggcacatcctcgttagttttatcaacatttaatattgcgccaccataactcctagtaactactccttgcaactctagtttttccaaatctctccttatggtctcttctgtaacttcaaactctttgctcagcttagatacataaactttcttttcctttattgctatttcctttattatttctagtctttctctaggtaacattacaattcctccttatatgaataagtttctatttattcacccctattatataattatattttaaatcatatgtaagacaattcaaatatagcgtatatttttttgtatttaatcaatccaactttaatataccaaattaacacagacaacacaatataaatcaaagttaattcttgactgttttttccgaataactatataatataagtaacttatactttttaaggaggtatttatgatacaaaaagcatttaaaatgaaattatttgaaggtaaagaagaagaatataaaaaaaggcataacgaaatttggccagaccttgtaaaggaattaaaatctcacggaacatcaaaatatttaatattttatgataaagacaccaatatattgttttcttatatagaaatggagaacgaagaactatgggatgaaattgccgaaacagatgcctgtaaaaagtggtgggcatttatgaaagacattatggaaacaaatcctgataatagtccaatatctgtggaattatctaatgtgttcaacttaaaataattatttgaattaaacaaatagagaaaaacttattagtgcaattataaacattgcactaataagttttcccctgcataaaaatataatctgcattgatttcactattcacttaaatagattttggaaccaatgcagattatttttatattatatattttctaagctttttgattttctttgtatcttctccagtttctataccctactttgttattcccccatacattctcgtaatttaatcctgttaattcttcaactgttgtacgagtttcagcatctacatcttcttttaatccaccatcttttaatcttgcaatttctttcttaagtacttcatgcgattcatgagatactttgaacttatatgatgatattataccataaacaagcagtattgccggcgcaactattaatataactgccatagctgttaatgcttctggaggttgtgatgttgatccagatttaaagttaaattcttgtaatataactccaactaggaaaacagcaagtgcctgtgaagctttacgcaacaaactcataaatcctgcgaaaacgccttctcttctatcagcagatactatttcatctacatctggaacaaaagtatagttattccaaggaacaaagtttattccacctcgtccgagtcctgctaatgccgatacaacatatagtgcaacaaggctatcaggaattgttccatatactattaaatatcctacaatacttgcaaggaatattaatgatacaactctaaatgctccaccaggacttaattttaatgtgcaataagttgctataccaactcctgcaatttggaatatatacattaatgccaacaagtttgatgctacaactgcacctttaaataatgcaaacactatgaaataagtaaatactgcattaaatgtatcttgtgctaaatatcctccgatatacattcctaaatgtgctctaaacgttctaattttaagagttgtaaccaaatctatgtaaattttcattacattttgtccaaatgataacttttcctttgagtgtctgccttctaatatctctatttcctctaaagatctttcccaagtaaatgtatacacaagaattaaaacaattataaatattacagtaaagattccaccagcaatcaaaaatgattgtggagactctttccctaatgtatttataagtcttccaggtataaatgcagctaaaaatgctgaaaattgggcaatatacattcttgcactagtaagcttagcacgaattttaaaatcagatgtcatttctgccgctaaggtatcataaggtataagtaccattgtatacacgatttcaaacgctatataagtcccaacgtaatataaataagagaaaccactgacccaaatagctgaatatacaataattaaaggtattgctgctaataaaaagaattttcttcttccaaatcttcttccaagcgcagttttgtgaaaattatctgttatgaatcccattgtcggacttgctactgcatcaactatacgagctaatgcaaatattgaactcgcttcaattggtgttaatccgcaaaaagttgtataaaagtataataaccatgcacttgttaaggcaaatgctcctgctcctataaaatcattcatcccataagaaaaataatttataaatcttattttcccatctttcttactcatatttcctcctacatatattataaattttattttttacatagtatttaagtatcaacgttttatagctttaatataaactctaaagaactacaaataaaatactataatatgactaatgcatgtccatttttaattcttagtttaattctgtattcttcctcaattcatcaaatcaatttctcttaatattttatatagtatgtatttattaaatatatctaagtgtcatttaccaaaagttttttataaaattctttttatcatgacattcctcctaagtattctaatatctaacattttaatcttgtcatcggttacttaaaacatttacatcacttacacttatatattacttccattccaacacaaagtcaatataatttcttttattttatttgttttttatttgtttatgttagttttgttttaaaaacaatctcaaatagttatatgttaacgttttagtacaatatttatcttccctcctttatcacaaatctgtatttaatacttttttaatataaaaatagcatagaaaacataaatttccatgctatttctaattttatatatacatttaattattcattataaactcttgtatatttcttctatatatttaatacttgaatctaaatcttcaggtattgtatcctcaagaattatatctatatatggttttctttcctttattagttttagtaataatggatagttaaattgaccttttccaatagacacttgttgtacctttccatctttatagataaaatcttttgcatgtataatcactatcctatcaccaaatagttcaaaagattttcttattatctcgtcttgtttatcatagttactttcgtctataaaattaatcggatcgaaaataacttgtaagttatttgattcaacattatctaaagctctttttaacctttctggagtattcattatatgctttgtaaccccttctattccaactacaatcccgaacttctctgcttctttcacaagtattcgtattgaatttaggctccttaaaaaggcttcctctgtattattcttttctgtataaatatattccttattaaaagctccagtttctgttccaactacattacaccccaaatattttgcgaaacgtatatgctctttaaatgtatctaatgattccttaagttcattatcatctggattagctaaattaatataacacccaagaatacttatatttacttcatatttattcaaagtattatttatgtattgggccatccctggtgtcatacatcctctagtaacttcaaattcagatattatttttttcgctacgaattgaacgctttttaaccctttttccttcattattcttcctatatcatctaacttataaagtccaatatcgtgtcctctaactccaattctcataatcgtaattcctttctcaaaataaatatagttttatatagataataaactcttttttaacaaaactcaacatcatttacttgctttatttttaaaaacaacataaaacaatatatatatttccttactttaattttatccaagctcactattctcaaggatttcctctaattatatttaattccccccttaattctcactactaaataatcactttcttttttactttttctttattttattttgtttttatgtagatttattttgtttcgtgatgtataatttgaattgagaataaatgataggaaaatttaatttatactacaataaattcactaagttattataataactatattgttaacacttacatgagatttaaatttattgtaattaatcgttacaccgataccttttattcattatttcaaaatacaaaaactttagagtattgtttataatgctctttacaaataaatattatgaggtgatataaaatgaaattaacagaaaaagaattacgtacaaaacttgacttagttgttgataaacttttaaacttagatagaccaacagatgaagaaaaattaactaaagaaggcggagaagccataggaatgtttccaagagattttggaattcaagaatgggattggccacaaggtgtaggtttatatggcttattaaagttagacaaacatgataaaagtaacaaatatctggattttttaaatgaatggtataaaaataatatatcgaatggattaccatcaaaaaacattaatacaactgcccctctattaacacttataaacctattagatgtaagtccaaatacagattttgaaaacctttgcctaaaatgggctgattggcttatgaactgtcttccaagaactaaagaaggtggattccaacatgttactagtgctaatggcgatagacaaggggttaggctaaacgaaagcgaaatgtggatagatactttatttatgactgtattatttttaaatagaatgggacaaaaatataatagacaagattggattaatgaatcaattcatcaagtccttattcatataaaatacttatatgataaaaaatcaggtctattctatcacggatggagtttcaatgaaaatagtaattttggagaagtattctggtgtagaggtaattcgtggttcacatttggaatcttagattatattgaaatgtttgacggtaaaatgaattcaggcctaaagaaatttctaattgatacatttaaggctcaagtaacgactttagttaaataccaatctaaatctggattatggcacacagttatagatgatcctacaagctatgaagaagtatctggctcagctgcaattgctgctgggatactaacaggaataagattagggatattagacgattcatttaaacctgctggtcaaaaagctatagaagcaatttgcaataatatagcaaaagatggaactgtattaaatgtatctggtggaactggaatgggctataataaagaacactataggaatataattatagccccaatggcatatggccaatcattgactataatggctcttgttgaagcacttaaccatattgattgttaatactaatttgttctaaaaatattatatatttgaattattgcttcaaatattaaatttatacattgataatccccatcttctattttgagaaaggggattattaatttttctctaatatttaatattttcttatactgcctaatgttctatctaaactatcatacacttctttagcacacatttctggagtttcttttccatacgctatcttattcaacgcatcaatgcatgatgtttattaaactattgttagattcaaatttctattaatttacaggcatttgcaattatattgtattgcttgagtagtatccaatacaacaatctaaaaatgccttgttaaaatattcatataattttaacaaggcatttatatcgccgttacaggatttttataattatcttactaaccagccaccatcaacggctaatatgtgtccattaacataatcagatgctctgcttgctaaaaatactattgctcccattaaatcgaatggttcagcccatctatccgctggtattcttccttgtatttctgcatttctttccttatctgctcttatcggtgcagtatttgcagtttttatatatccaggtgctatagcattaatttgaatattcttgcttgccaattcattagcgaatgcctttgttattccagccactccatgcttacttgctgtataaggtggtacgaatttcccaccttggaacgccaacattgatgctatattaattattttacccgagccttgatttaccatgattttagcgacttcttgacttaaaaagtatactgcgtttaaattaatatccattacagcattccaatcttcttctttgtactcaagaagcggagctctccttattgttcccgcattattaactaatacatctatcttcccatacacttccattgctatttttataactttttctctatcttctttttttgtcaaatctgcttgaacaaatgttactgatctcccttctttttctattaacaatctagtttcatcccaatttgtatcataagttggaataattaaatcagcaccggcttttgctaatgctacagcatacccttgaccaagtcctgtatttcctcctgtaactatagctacctttccatacaatctaaaaaaatccattgaaaattcatgtaaaatatttgacataattccacttcctcttttctgcttttatcttaattcgttaatttttgtatgatccatatcaccaaaagtcttgttttctccacacattccccatataaatgaataattttgagttccaattcctgaatgtattgaccaacttggtgaaattactgcttgttcattcttcatcactatatgccttgtttcttgtccttcacccataaaatgaattactgcttgatcttcaggtacatcaagatataagtatacttccatacgtctttcatgagtatgacatggcatggtgttccacccacttccctgctctagtattgttaaccccattactaactgacagctttcacatactgcaggatgaacatactgatttattgttcttttattcatgtttatttcatcgccacattttattttattagctttttccaaatctatttttactgttggatatgatttaagtgctggtgcagaatttatataaaacttagctggcttttttccattagctgatttaaattctatatttttagtaccttgtccaacatataatccatctctataatttagattatattctactccatctgctataattgttccttctccacctacattaataactccaagttctcttctttccaaaaagtaatctgttcctaattctttagaagctccaagctttaatatttcttttactggtgtaattcctccaaatatgattctgtcattatggctataaactaaattcacttcgtcaccgacaaatactttctcaactaaataatgtcttcttaacgtttctgtgtcgtactgtttagaatcttctggatgatttgagtatctaatttccattttcataatattctctccttgtataataagtttatagtcaattacataaccgctataaacttatttgttttatattttattgttaaatactatattatctttacaaattgaatattatttattacaaacctaaattaatttctcttagacaaaacgtccttttcgtattcctttacctccttgatccagctttcaccaactggtacattgttcttttcacaatagtaattccaaatatcacccattggataagttttaaattcttccattaaagctaatctttctgtgaagtttccttcttcttgtaattcccttagcttatcattcggtgttaacattgcatttaataaagcttttatcatatttcttgaaccaattgtccatgctgcaattctattaatacttgcatcaaagaaatcaagaccaataattactctatctaatgcatcgtttcttactatttccttcgctatttctttaagttcatcgtcataaactacaacgtggtctgaatcccatctaactggtctacttacgtgaagagctactttttcatcgaataataacattgcagaaagtttatctgaaacaacttcagttggatggtagtggcctgtatccattaatgacattatgttatttttagctgcgtaatttaaataaaattcgtttgaacctactgtataagcttctgcccctatcccaaatacttttgactcaacgcagtcaaggttatattttttatctatttgaactttaaaaatttcatctaaagattctttaagtcttcttcttggtcctaatctatcactcggaatatctttgtatccatctggaatccaaatattagttaagcaagtttgccctaattccttaccaaaatattctccaatttttcttgatgcaattgaatgtcttatccaaaagtctcttatctctttatcgggatgggaaagtgttaatccatctgctgactttggatgtgaaaatattgtcggattgaaatctaaccctaacccattttcttttgcccatttaacccaatttgcaaaatgttctggctttatttcatctctgtctacaaattcgccattagtttctaaataaattgcgtgaagattaactttgtgttttcctggaattaagcttaatgctttatctaaatcttttctaagttcttcagcgtttctagctgcacctggataattaccattacattgaattcctccagataactcattttgaactacttcaaatcccttaacatcatcaccttgccagcaatgaattgatattttaactttattaagttcatccaaaaccttatctacatctattccccatttttcatattcttttttagctaattcatatttttctttaacattcatttttacgcctcctatttatatttaaatttactgattatctttatttgcaatatccaataatccactatatattccaaacaaatagcagtaaagaattgaatattgtagtttgtattattgtgagagagtgaacaaattaattggatttaaatatcttaatatcaaaagattcttttattacttgtctagcttcacttaaatctttaaaaatatctttactcatcatttgagcaacaatatttcctatagctgtagcttcaactggacctgcaagtacttctttacctgtaactttagaaaccagctcatttaaaagattattctgacagcctccaccaaatatatttattctttcaaatttcttttcaaagatttcctctaaattagaaacagcttttttataacagtgagctaaactattaaacacacacatagctatctcccctacctcttgaggaaccttttgactagtttcaacacaatataatttaatttcctcaaccatgttttctggtttaaggaatctgtcatgatctacatctactattgatgaaaaatcaatatgttcttttgccaaatctactaattgtccaaaagaatatttattatctaaattccttctaacttcttggattacccatagacccataatgtttttcaggaatctatatctatagtctattccaccttcatttgtaaaattatgttccatagcttgaggcacacaaattgggaatctattttcaacaccaatcaatgaccaagttcccgaacttaagtaaatgctgtcgctgtcattacaaactgatgatataaatgctgaaccagtatcatgagtcgcaggaagtattacttccatatcaaatccaaattcttcttctagctcttttctcaaagtaccaagattagttttgggtaattttatctcttgaaagatatccttcttaattcctagctcatccagtattttttcatcccaagttctctcaaaagagttaactaactgtgttgatgatgcatttgtgtattcattcaccttttttcctgtaagtaaaaaatttaagtaatcaggtatcattaagaaagtttttgccttatctaatatttccggattattcttctttaaggaaagcaattgatataccgtattaaacctttgaaattggatacctgtatataaatacatcatatccttcggaatgattttaaatgcttcctccatcattccttctgtcctatcatctctataagctacagcattcccaagtatcttatcgttttcacctaacaaaacaaaatctactgcccacgtatctattcctatactactaggtatctttcccatttccttacatttcttaattcctttttttatatcattaaataattgttctatattccaacaatattcatttcctattttgctaattccgttttcaaatctatatatttcttctaaatttatctttccattttctactgaacctaaaatatgccttccgcttgaagccccaatatcaatagctaaatagtactccatatctctcctcctgttcttttcacacatcactctatatttaaattatattgtatgaaaaaactatttttaatatcggcatttgtataaattattatccttatttgcaattataaaactttgcagtctccttaatataattttttatatcttgaattactacataatataaataacactaggttaaattattattgaaaatcctccttataatcttagactgagcaagaatctcatcccactaatcttagctataattaaatatgttctctataaaaacaattatatttaacttactacataaatttaaataaaattagtggaaatgtaatataaatatttaaatttctactaatttcttactgcaaaaaatcggatttttgtattgtacaacctacaacaatatagtataattattatagaaaatacttaaggctatggcagtcttaggagtgttatatattaactatgtttaatttattaattgaataagattttagcaaaggagctagagaatattaaaataattctttagctttttatttttttaatatgaattttttaccatatatgaatttatatgtaaataacttccatgtggcaatttcttatttcttgttgacaatttatcatttatactctaaaattttttttaaattattaatgtttttaattagttaatattaatttaaataaatgttgtgtattctgaaaggagatcttattaatgaacaaaatcaatgaaatttttgcttcaaatgtattcagcgatgctgtaatgaaagaacgtcttcctaaagctacttataaagctttaaaaaagacaattgaaaaaggaactactcttgaaccagatgtagcagatgttgttgcagctgcaatgaaagattgggctgttgaaaaaggtgctactcactttactcactggttccaacctatgactggaattactgctgaaaagcatgattcttttataaatccaacttctgacggaaaagttatattagaattctcaggaaaagaattaatcaaaggtgaaccagatgcatcttcattcccttcaggaggacttagagctacttttgaagctagaggatatactgcatgggattgtacttcaccagcattcctaaaagatggttctttatgtataccaactgcattctgttcttataacggagaagctttagataagaaaactccattattacgttcaatggaagctttaaacaaacaagctctacgtgttttaaaagcattaggtaatactactactaaaagagtaattacaactgttggtcctgaacaagaatacttcctaatcgataagtcaatgtatgatgctcgtaaagaccttatcttaacaggaagaacattattcggagcaaaaccttcaaagggtcaagaacttgaagatcattacttcggaacaatcaaacaaagaatttctgatttcatgaaagaagtagatgaagaactttggaagcttggaatattagctaaaactaagcataacgaagttgctcctgctcaacatgagttagctcctatatttagcacaacaaatatatcgactgaccataaccaacttacaatggaaataatgaagaaagttgctgcaaaacatgatttatattgcttgcttcatgaaaaaccattcgctggcgtaaacggatcaggtaagcataataactggtcaatgggtactgatgatggaatgaatcttcttgaaccaggtaaatctccacacgaaaatcaacaattccttttattcctttgtgctgtaataaaagctgttgatgaatatccaagcttattaagagtatcagctgctaatgctggaaatgatcatagattaggtgctaacgaagctcctcctgctataatctctatcttcttaggcgatcaattagaagatgtattagaacaaattgaaaagggtccagctacaagttctaagtctgcaagtgaattaactattggagtaaatacattacctccacttccaaaagatgcaaccgatagaaacagaacttctccatttgcgtttactggaaacaaattcgaatttagaatggttccatcttctgcttcaattgctggatgtaactttgtattaaatactatagttgctgaaactttatctgaaattgcagataaacttgaaaaggctactgatttagatgctgaaatccaagcaatcttaactgatattgttaagaaccataagagaattatatttaatggtaatggatattccgatgaatgggttgctgaagcagaaagaagaggtcttccaaatattcactcaactgtggaagctgctaaagctatgatagatgagaagaatcaagctgtattagaaaagcatggagttttaactagagtagaatcaacatctcgttatgaaatcactttagaaaactacaataaaattataaatattgaagctttaacaacacttgaaatggcaaaacgtcaaattatacctgctgtaattcaatatactacaagtcttgctgaatcaataaacacaataaaggctacaggtataaatgtagatatttcagttcaaactgaatcattaactgaaatttcaactttattagcttcattaaataagaatgtttcacttcttgaaaaagcagttgaaaaggctgataacttcgaaggtgatatattcgatttaggaatgatgtacagatacgaagtatttgaacaaatgaatactttaagagctgatgctgataagcttgaaactctagtagacgaagagttctggccacttccaacttatagcgatatgttattcaacgtttaatataaaatctttatattaaatggagtgattctaaaaagaatcactccattttatatattattactaagttaatttatataatgttattattagaaaagctaaatgctaatgacattcttccataaaattccaccaacatttaatacaatcatatttcatttgctagttataaaattgtatagtgctcctatgagattagcatcatttctaaacttacagctaactacattaggtagtggtaaatcatcaatttcaaaactcttctgatacttgtccacattcctcttaatatattgtatcaatatctcttgactacttatccctccaccgattgcaaatatttctggatctaatatacactgtaaattaaaaatttgtaccgctagcttataagtgaaatcatctaaaattttaagaatatctggatcgttgttatttgcatattcaaatattttatacccatctaattcatctggcggaagactttttacctttgcaacttcatttatcaatgctttagaaccacttatagatccccaacactcatccgtattctcagtattatttacattcgtatttataaaactaaactcacctgcaaagaagttttttcctttgtggattttcttatttcgaactattcctccacccacacctgttcctagaactattacaactccatcatcgaaatcttttaaacttcctttccaaacctctgctaaagctgcacattttccatcattctctattgtaatctttatcggacatctttctttaagaatttttacaatctctttaccttcattatatgatagtgcaccacctgtataagcataacctttttcactatctaatactcctggcatacttatagctattccttctatatcatctttatatatatcatagatttcacctattacatctataaaactttcaattttatcaagtggtgttggttttttacccctctcaataaactccaaatcctctgtcatcagtgcatacttaatagaacttccaccaacatctaacactaaatatctcatctctacacccctcattattatctttaaaatttaatttgcccacactctatgccctaatatttacaaaaataacgtttactaaaataatcatagcataatgttaaacctctttcaattcaaagtaagtaacttcaaagcatctcaattattaacaaaaaaagctctctcagcttttcattaagatagcttcttcattcttaaattatgcattatatatgttaaaagagattaacttattaaaatttattctaaactatagcactgcggaataaataatttttaaacataaattgaattatttaaaagttatatattcctttcatttcaacttagaaacttttctaatttaagtaaatctaaaattgttaattctgttcattttatattctctaggcgtcattccaaattttttcttgaatatcttgtaaaagtatgttggattctcatatcctacaaactcaattatttcaataatcgaatactcagttaatttgattaattcaactgctttgcttaactttttttcttgcaataattctttaaaagtcattttagtatgtttctttattaatttgctaagtttataatctggttgatttaatttttctgagagttctagcagagtagctgtactataaaattcctctatgtatttaagactctgaattatcaacatcttctcatagttatccacagaatatgtctctatatcctgtgaattttttactaactccactaataaaagccctactagcaattttattgtcgcttttttcattatcgaattagtatacagctcaattattattttttctaataactcttgaatattttttctttcagaaactttaaaatatagatattctccttcatcataatctgtatataatgtagttagtaaaaatttacttactatattttctttatctaacagagttattatatagtcaaaaaattcaggcctgattataaagttaataattatgtcctctttgtccgatgcttttatctcatgagttatatattgattcaagaaaattaattcgcccttttgtaaagttatttcattgttatctatgatttgagtaagcttgccttgataaacataattaaactcaatgtaattatgattatgacttggaaagttaataaatctaatatgctttctaatatctattagttccccacttggtagtagtttattgctatctacaatgaaacttccatcgtctgtataaatgcttctatttacagaattctctccacttaaaatgtttacttcttcatctgtcagagcaatcagtttatcatgaatttcttttaacatatgttaattctcctttttcattatctcaagcttcatcaaagtattctcttttccatcttcatttacttgaggaaggatgtacacaatatccccattctacttttctttcttaactctataaactagaaatattccataacaaactaaaagaagcgctattaatatcttgatatcaaatatattttctcctaagattaatgctgataacaatgttccaaatacaggtattaaaaaattaaatactgatattaatcctactttgttatattttaataattgtgtccaaacagtaaaagctattgatgatagtagtgccatatatataagtagtaatgttgatttcgctgtaaatccttctaagctacctcctaatgcaaatcctaatgctgtaagaagaattcctcctataaatagctgaaaaccagttactattgaaggttcttgagtttgcgttatcttcttgccatatattgctgacacagcaaatattattgcagcaaccattataaatccctcacctttaaaagtgacagatgttcctcctaatgactctccatttaagttaacaattactactcctacaaatccaataacacatcctattatcttatttaaatttaacctatcattcttatatataaaatgagctagaattatacttacaaaagttcctgttccatttattatagatcctctaacccctgtagtatatgacattcccacataaaagaatatatattgaagtgcagtttgagttaaccctaataatgttatctgaccaaactgctttctagtaaatttaaatataactctttttgacataagctcaaatatgagtataaaaatacctgcaagtgtaaacctatatccggcaaaaattaatttagagcctacatcacttatattaaatagtgaatatccaacttttatagccggatatgcacttccccataaaaagcaacacaatgttgctaaaagtacaatattttttctgttagtataaacttttacttcatccattttatatgtttctctctcccgcctaatcattgtaagtagttcatccaatcactttttattccgcattcattctaattctatctaatacttccataactcgaattgattcatttaaagttaaataatcactttcaagcttcgactcttttaaacagttatgaatttctttaatctctgcatacatgtcatcaaattctatatctttttcaattgtatacgacttgcccgaatttagattaacaacagctttgtttggtctattatacatcggaatctccatccatccctttgttcctctaataatagctgtcctttctttatttctatcaattgccccttctacagttcctattactccatcttcaaaagaaagtattgctttaaaataggaatcgactcctgattcatttatatccatgtaagatttgacacttttaacctctgaatcgatcatatccattacgaatgacaatggataaattcctacatctagtaacgccccaccttggtctttatctaataaatatgatcccggtttaatgttttctacattattgcaaaaattagcttctatagccgttatatctccaatctctttatttcttattactttcttaatatcactaattatcggaataaaccttgtcttcattgcttccataaagaatgtattatttaacacagcttctttttttatttccttcatttcttctgaatttatccctacaggcttctcacaaagcacagcctttttatgccttaaagcttcgatggaccagtgtttatgaaagccgtgaggtaatgctatatatatagcatccacttcttcatctcttaataattcattataattttcataaactttctcacaattatacttatcataaaattcatcacgcttttccttagttctagatgctatagcatatagtttaccttcattagagtatgataaactcttcgcaaatcttaaggctatatttccaagtcctataattccccatctaatcattgcttttcctccttattataaacctgcaattttattcatctttacttattaaaaatacttttctatattactatatcatactcttcatttatacacgctaatcgttagaataaaaatatccgcaatatttggaacgtattaaataattattagtatgcaatcatatatttctgcctataaaaagtttgtaagcagaaaagtcttaagaataaatatatccatactcttaagactttaaattcaatttattatgttaactatacttctgctgattcatcaatatctttcatagttaatgatattctctttctcttttcatcaacttccaatatcgctacctttactatatctccaactttaactatatctaaaggatgctttacaaatctatttgccatttgacttttgtgaactaatccatcttgatgcactcctatatctacaaatgctccaaaatcagatacattcctaacagttccagctaaaaccataccaggttttaagtccttaagttctattattcccgtttttagtattggctttggcatttcttctctaggatctctgcctggcttctttaattcttttattatatcctttagagtcatctctccaacttccaatgtttcacttagtttttttaatccttgagattgagccctttcatcaatgtcacctaatttattattcttaaggtcttctttattgtaaccaagtaattctattagcttcttagctatagcataagactctggatgcacagatgtattatccaaaggttctttgctatcatcaactcttaaaaatccagcacattgctcataagccttttgacctaatctcttaacttttaatagttcttttcttgaagtgaatcttcctacttcttctctatagtcaacaatatttttagcgatagatgcatttattcccgaaatatgtgttaaaagcgatggtgttgctatatttaagtcaactccaacagtgttaactgaatcttctactacacctgctaaggattcttctaactttttaggagcgacatcgtgctgatattgtcctactcctatagccttaggatctatcttaactagttccgcaagtggatcttgcaaccttcttcctattgaaattgctcctcttactgtaacatctaaatctggatattccttagttgcaagttctgatgctgaataaactgacgctcctgcttcagatactattacatatgctaattcttttccagtttcattttttatttccgtaatcatttctgcgatgacttcttctgattctcttgatgctgtaccatttccaagggatataacatcaacattatgcttagcaataagagcttttaaagttttctttgttccttcgatgtctcttttaggcactgtaggatatactgctgtattttccaaaaacttccctgttgcatctagaatcgctattttacagccagttctaaaccctgggtcatatcccattactacttttcctttaataggcgcttgtaataacaatgctttcaagttttctttaaatatcttaatagcaccttcttcacctatatcagttaattcacttcttatttctctttctattgatggataaattaatctttttaacgaatctctaattgcaagttttaatttttcatctaaagtttcattgccttttaatacttgattttctaagtattgaattatcttgtcttcattaacagttatcttaacatttaggattttttctttttctcctctgtttatggctaatattctatgaggcggtatcttatttactgcttcagaatattcataatacatttcatatggagttggttcatctgaacttccctttgattctatattaccttctctaataacaaattctcttatatactttctgtacttagcttcatcagaaatgctttcagctattatatctaaagctccttggatagcttcttgactatttgtaactcccttttcttcacttatatacttagctgcctcttcatctaggtctccacttaattttccttccaaaattagttctgcaagaggctttaatcccttttctactgctattgttgcttttgttctctttttaggtttaaaaggtctatatatatcttcaacttctgttaaagtcgttgcattctctaatgcttttcctatttcattagtatatttttcttgttcttgtataagccttgtaacatcagcttttctttcctctaaatttcttagatacgtaagtctttcagataattttcttaagacttcatctgaaagtcctcctgttgcttcttttctatatcttgaaataaatggaactgtatttccatcatctaaaagtccaataacattttgaacctggcttaactttatttctaattcttttgcgattctttcttcaattgaattcataatttcctcctgcttatattaaattacctaaatagtcattgccacaacaatactattttaccatataaatcattattgccattactatttttagtaatggcaataatcctatatcactattaatattataaacttattttaattgaaagcaataattatatatatttttcttctacagttgtcctcactttcagtttcccattttcattactaattccaagaattaattttcttaaatcatttttgctcaattcattatatactacgatttcttgtttttgcccgtcgttataatagcagagtttaagctctgttactctattcaaataacttaaaattaaagtcttaactattgcccattctttcttatattggatatctttaatggatgtttttcaattccctcaaagcttaaatatatatcctttaagtctttcacctatcaagtttttaataagaacatcttttgtttctggtatattaaaatacatatttatcccctccaattttattgaataagtatagaagaatgaattccatggatatatgttatcccaatgcccaaaagtaacattaatccaaaataacttaatgcaaatataaacctaatagatgtctttacttcgtaatacgatttatctggatttctatattgttcaataacttttgcaactccaagtataagcaatagtacaataattggattaaaggccttaaagagagcaattataccaattggtattcctatgagccataactttggtgatatagccgaaaccactctcccaccatcaagcggatgaacaggtataagattaaatagatttaacataaaacctacatatgctagtgctgccaaaaagtcttctccagatataaagtaaaacaataaacaaattagtgcacctatacttcctaacagaggacctcctatagcaactttcgcttctgttgctgaatctttaggttcttctttcatactaataaaagcacctacaaaaggaatgaagattggaaggcttacatctaatttgattaatttagccgtaagataatgtcccatttcatgaattaaaagcaataatacaaagccaactccaaatgccactccatacatcttagcgtatatgacaatcattagtagcatagatataaaggtagatgcaaatttaccaagctttaataatattattaagaattttaattttcctagaactaaaaataaaatagctttaaatttcaaaagtattaatagaaaagctccgactgctcctaaaattccttttttatcttttaattttgtaactaaaccattttccttaaagtgttcttctgtattaatggcaccagtttcttctttcaaattatcataatctatgtttgaattaatattttccaattcatttttatcgttgtccataaattttccttctctttcttatacatgatgttaaagcattaagctaaagttacttttaataaactatactaagaataatgtatactgccttctccaactcctcctccgctatacttagtataaatgccttttattaaaagctgcttacaacaatattaaattaacctaaaatataaatcgctgatccaagctttaaatttagattttattcttaaacacaacaagtggcaacatgatctcaaaagttgtccctattccaccactatctataattctaatatcaccattatgtttatttaatattttctttgtgatagataatccaagtcctgttcctccagtttttgagtttcttgatttatcaactctaacaaatgggttaaatatattttctctgtatttttgaggaatacattcaccgttatctgataatataatgtaaaaataattatctctcacctctgtctttactcctattctacttcctacaggattgtatttaactttattgtccaaaacattatttatagctctagataacttttcttcatttatcattacataataggtctcttcaattatttcaaaatcatattcgaattttttatgatcaaattctggaatatagtttgctattatttgtctaacaaattcagcaatatctgcttttacggtaatcattttataatcagaattatcatataatgaaaattcgaataagtctgttattaatttatttgctctttgtgaattcttatttattatgtttaagtattctaacttttccttttcatctaaatcattattattaattaaaatctcactatatcctagaattgatgaaagagggttttttaaatcatgcgatatatctaatattaacccctcttttatcttctctagcttttccttttggcttctttcattttgtatagttcctgccatcatattgaatccatttgctaactcaagaaattcattctttttatctatatctaaacgtatattataattaccatgcgatatctctattactccagccaataatgtctttattggttttataaatgcgctagaagttgcttttgctaaaatatacactattgagagaattaatagaacattgaacgcacccattatttttattattagattatgaggaattactttagtgattctattcggctttgtaatctctgaatacgggaagccaactaccactaaagaatcctcttcttttagatacttgctatatagtgaatatttaacattatcttttgtttcaattattgaattattgaaatctgataatgcaaacattgttctaatatcatcatttaatgattcttcattatcctttgttaatccaaataaatacatgtagctttgcaaatttatatttttaaattcctcgataacatgtcccttcatgtaacgaactttattctcattatttatttttaccataaaaccatctatatcagacaaatccccatccgttatacttgtataatcttttacaagcttattttgtagctctctaaaataagaattatatgtattaggtccgcataaagttccataaacaacaattgagccaataatagctattaatagtattatgtttatagctatatatcccaaaaaatatataaagaataactctgttgtaacactcctttttattcttttagctttcatgcattgcaaccctctcgattttataacctatccctcttatggtttttatgtagattggattcttaggatcatcctctattttctctctaatatggcttaaatgaaccattatattattagagtcaccaaaataagcttcttcccatacttcttcatatatttgtttcttagtaaatacttttcccaaatttgaaactaataactttaaaattttgaattcctttggattgagatcaatctttctattccccttataaacttcgaaagtctcagtaaatagttttaactctcctgtcgaataaattatgtctttatgctcagcatatttgtaacatcttctaagattagatgccactcttgcagataattcaattggacttataggctttactaaataatcatcagctccaagtcctaaagccaaaactttatctgaatcatttcccatcgctgtaatacagattataggaatagtagagatggctcgtaccttttgtataactgaaatcccatcaacatttggcatcattatatctaataaaattaaatctattttttcattttcaaatatatttaaagcttctcttccatcggaagcttcataaacttcatagttttcctttctcatatgcaatgaaataagatttctaatatccctttcatcctcaactattagaatattcataaattcaactcctccattaatatgaatatattttatcatatttatataccattttaggaattaatttcaattattaattctaatatgatacgctaagcatatcagaatacttattttatataaatttgttattgcttgaataaagatctaacggtataattattatgtaaatatttaccagaggtgatgggtttatggttaaaaatattagtagaatttgctctttctcattattatttttactctcaatacttgctttaaacgaatttcaaataatgagttactcaattaacttaaaaaatatattttactttctagtattaattttgattatgttttcgtctgtcacaactcttctaacaaacaaatcaggctttttcaaatttgttagtgtagtaataatgatagcattggtagttggaggaatcatgtctatactaaaacctggacttaatatttccctgtatgtgtgcataattcttattgccgtctattctttaatcgatatattttataaagctgcttagctatacagatatgcaagtttattttcgctctttattttatataaactttacttttagaatttctctcaataaaaaggcctctatcataaaatcatttagatagaggacttttcattaagagaatatatattcttttattgttgctttagatatgcatttataaacatatcgatctcaccatccattaccgatgtaacatttgatgtttcgacattagttctatgatctttaaccatgctgtatggatgaaatacgtatgatcttatttgacttccccatcccatatcttttaattccccggttaaatcctcaattttttctttatgtgctctttcttttagttcaactagtttagatttcagcatttccatagctgtatccctgttagagaattggcttctttcgttttggcactgtacaactactccggtaggaatatgagttattcttactgctgagtctgttttattaacatgctgacctccagcacctcctgatctataagtatctatttttagatcatcagatcttatttctatatcttgttcctttgtaagttccggaagaacttccatagatgcaaatgatgtttgcctcttaccattagcattatatggtgatattctaaccagcctatgaatacctttctccgcttttaagtaaccatatgcatattctccagtaacttttaaagtaacacttttaattccagcttcatctcctgggagtaaatctagagtctcaatactatagccttgtttttcacaccatcttgtatacatccttaagagcatttctgtccaatcattagcatcagtacctccaacaccaacatgaagtgtcaaaatggcattatttttatcatattctccacataagagcactttcatgttataatcatcaatctgtgcttgtatatctcttaacgtttgtattatttcattagcagattcttcatcgtcatcttccataatttcttttaatacttctatatcttcaatctgagacttcaacttatcgaaactttcaattttgtcctttatcgatttactcttttttgtaacttcttctgccttttttatattatcccagaaacctgattcttgcatttgatattctaactcattgagctccttttctaacctatctcggtcaaagtgaagcccccatttcttctatagatttttttatacctggaagtttaaccaattccttttcaagttcaattatcatctattattcacctctttcaaaaaatccagtattaataagaattccgtagaagccttcttaaaactgtatttaattctaaataacaattcttcaaacctctacggaatttattatatcatatttatcatttttcaaactctttagagcttattacaaagcttgaaacttgtttatgcttctcttccacaacaatttttaaatttcttaccgctaccacaagggcataattcatttcttccatgcttatctagatttctaactggagctactggccctgcactaggtccacctggtccacctggttgattttgtcctggccctggagctgcggcacttgaagattcctcatgaattgccgcagtttcttgagcaacccttactctttctggtgcaacttctattctaacatggaataacagtctaactgtttcttctttgattgctttaatcatatcattaaacatttcgctaccttccatttggtacgcttgaactggatcaatttgtttgaatgattgaagccctataccttgttttaaatgatccatattatctatatgattcatccatttagtatcaacagctcttaaaagaacaactctttcaacttctcttaatctttctgcaccaaactcttcttccttatgttcatagaacttacgtgctgattcaaataagctttcgattatttcctcatttgacagattttcaagactaggtaaattaactgtacctggcgctatacatatatcttgtaaagcaaccattagatgcaagaattcttctctataatcttctgattcacctgtaacataagtattaacagcgtcagcaataatatcctttgtcattgataatatttcttcttttacatcttcgccttcaagaacttctgatctttgtttgtagataacttctctttggatattcattacatcgtcataacccaataattgttttctaatatcgaagttattaccttcaaccttcttttgagcattctcaatagcttttgaaaccattttgctttcaattgcttcttcttcttgaagtcctaatttttcaacaacaccttgaattttttctgatccaaatattctcattagatcatcttctaaggaaataaagaatgttgattcacctggatctccttgtcttcctgaacgtcctcttaactggttatctattcttcttgattcatgtctttcagtacctattattttaagaccgccaagttcaactacaccttcgccaagcttgatatcagtacctctacctgccatattagtagctatagtaaccatgcccttttcaccagcatgacttattatttcagcttcttgttcatggaatttagcatttaatacttgatgtggtactccttttttcttaagcatacttgatacaagttctgacttttcaatacttactgtaccaactaatactggttgccctttagcatgagctttttcaacctctgaagcaactgcctttatttttccaagctctgtgctaaatactaagtctggattatcttttcttgctattggtctatgtgttggtataacaataacatctaacccgtaaatttctctaaattcattttcttctgttaatgcagtaccagtcatacctgataactttttatacattctaaaataattttggaatgttatagtagccaaagtttttgattctctagcgattttaactccttctttagcttctatcgcttgatgaagaccatctgaataccttcttccctccataagtcttcctgtaaattcatcaacaattattacttcgccatctttaaccatgtaatctttgtctcttctcatggcaaagtttgcttttaacgcttgagttacatagtgttgtaattcaatattttcagcatctgcataattggctactttaaaggttacttctgcttttctaacaccttcatcagttaacattactgcatttgctttttcatctctagtaaaatctttctctacaactaacttctttgcaaaatagtctgcaactttataaaattcagtagatttttcaccttgacccgaaattataagtggagttctagcttcatctattaatattgagtcaacttcatcgactatagcaaaatttaatggtctttgaactctttcctctttgtaaataaccatgttatctcttaagtagtcaaatccaaattcattattagttccataagtgatatctgacgcatatgattctcttctttgatcattatttaattcatgtacaataacacctgtagttaatcctaagaaaccatataactcacccatctgctcagcatctctttttgcaagatagtcgttaactgttactatgtgaacaccatttccacttaacccatttaagtacgctggtaaagtagcaactagagttttaccttcacctgttttcatttctgatattctaccttgatgaagtatcataccacccataagttgttcatcatagtgcttcattcctaaaactctttttgaagcttctcttacaactgcgaatgcttctggtaaaatatcatctaatgtttcaccatttgctaatctttctttaaatgctggagtttttgcctttaactcctcatcagaaagcttttgcagctcttcatctagatcatttattttttgtatagtaggtttgagccttttaacttctctttcactatatgttccaaatacggcatttaatagtcccataatgtcatcctttcgaaattatatatttcacgttaatttccaatatattttaactatccataattcataatctgtaatttattttataaatcacgtattttataattataacattttacttatcttattttcaataaaactcatgatttttgtattaaatcctatataaagcacccaattttaacttttttttaatattttaatcacaaattattaatattaattgaaaattttatgtaaaaatattgtcattatctgttcaatcatttgatatgaaaaataactgtccaatgatgcaaattaaataagcacattggacagccattattaaaatctcttatatgttatatgaattctggttctaacaaaccataatccccatcttttctcttataaattacatttactttactactatctgcatcctgatatacaaagaaattatgtcctaataaatccatttgaagaattgcctcttcagaattcattggttttaccccaaatttctttaccttaaccaatttaccatcgtcctcttctgatggcttaatatctatattatttatttctccaaatctcaatgacccactatgttttctagataatctagttttttgttttctaatttgtctttctaatttatcttccactaagtcaagagatttatacatatcggaagttgattcttcgcctcttaatactactccattaaaaggaatcataacttctattttatgtctatttttttgaacacttagtgtcgccttagcttctacattcacttcaaaatacttttccaatttgcttatctttttttgcactatttcttttagcgcatctgttagttccatattttttgctataactgtgactttcataaattccagcccctctcatatgaaaaagtttttaaacttaatatctttaagttattaatattttatcacttttttattaacttaacaagagaattatcagtaaattctgaaaactaaagacaaaaaataaatctaatcccaaactttagattagattcctcacatttcctattaatgataattttaaaataaatagaggtaaagctagttgacctggtttttgaccccacactcgcctgctggagcttttgctaatagaatttaatccctcactactaaccctctcagaatacaatctggcaggacttacttctataccgcaccatgctccttagacattttgtctaaattacgtggatcgttttgcctgcgactagcttcgactttcaaccacaaacctagctttacattaatattatatatgacttttagctaaggtcaagagttttatgtcttttacttgatattttcttaataatttataagcttctttaagagttgcacctgtagttgttacatcatctaccagtataatattatattttccaatttctaatcctttttttattttgaaagcatcttttatattttcatatctttcatccttctttaattttttctgttcttttgtttctttatcctttatcaaaacttctagagcttcaattgataaatcattagctattttctttgctatatactcacactgattaaatcccctaatctttttagatttttttgatagtggtatataggttattacatactcctgatatttcaagtttcttataatatattcttctaaaaattctgctaatatatctcctgctgtaaaattgcttttatatttaaatttaagtattaaatcttttaatactcctccataatacccataacttattatttcatcttgatacgaatctgctattgtttttatacttttcatacaatgctcgcatataccaaagcagttatcttctttacatataatgcaataattttctcttggatatattacttcaattaatccttccaatatactttttataattctattaaacgcttttcccatacctttttattgaaatctcttgccatattctttgccttctcaatatcttctgatatatcgtttgataccaaaagaacctctggtaattttagatttacatttcttatttggccacatatatacaaaagctttttataagtatatctttcattatcagcaaaaagtactactgcatcatccatatagcaatattcaagtaactcctctattttattagttattataaatattgccttatccttgtattttgatactttttcactcttttttatatcatcatttcctgaaacttttattacttttacatttgaaagttttagtttattacaaaaataatcatataccatgtcaagcttctctttattgggtacataaatagccaccttatggctattttccctgaaccatttaagatagtcatatagagaaaatggaatatctgaattcaaatctattcgtgtagttaataccctaggctccacaaacggttttttataattatatgctgcaagttcgaacttttcgcctactaaagtcgtcttttctatgctatatagcaaaactctttctcctatgtttgaacacatttctaacatctctcttatatttacattacttagattggagaagtatgttatatcatcaaaaataaccaaatcatagttctgcttaatcttcattaagttattgtagtgcgtaaaagtaagtttagcatttgaaatttcttttacaacatacgaatgagttatatcagaatacatttctcttgttatatttactaattctttgttttcaccttcttttccccatacatataagacatttccattattttgtgaaactttacttattatctttgaaaaaacacacgatgtattaaatggaactgttattactgttaaaaatttgatatttttcttataccaataatctatcttatcaaatgcatactttaaatcttctaaagttactttacataaattcctcatacacctatctcctttcccttattcttcgaattcatctttggttattatctctcttattctatatctcaaagatgagtatctttctatactatttgtattattaatcatatacattaatgctttttgaaacccaacaactactactaattgttttgccctcgtaatacctgtataaagcaaattacgattcataagaaatggcgatcccataaataccggaattattacaaccttaaattcacttccttggcttttatgtattgtagtagcataagccaaatccaactcatctaaaaaattaaaatcatatataacttttctttcttcatcaaatatgattgtgagtgtttttctttcttcatcgatgctttctatgaatcccagatcaccattaaaaactcccactccttcattttcgccataaccactaaccctaatccactttaatgtataattgttttttgtttgcattaccttatcaccttctctgaaaattatatctcgagaagtcttttcctttttatcttttgatgatgcattaaacatttcttgaagcttcgtatttaaatttgtgactccaagcacaccttttctcataggagttaaaacctgcatatccttcagtttattccaagacttattaaacttagggagtcttctatttattagatccattatagtatttgcaattctttcttgattatcttcgctaataaagaaaaaatctctatctttttgatttagcaaaggcatctgtccctcatttattctatgagcatttactacaattaaactttctgatccttgcctaaatatctcttttaatcttaccacctttatataatcgctttctataagatcttttagcacatttcctggtccaacagaaggtaattgatcaacatctcccacaattatcaacctagttcctaaattaattgcttttagtagattctgcattaagataatgtcaatcatagacgcctcatcaattattattacatcacaatctagaggcgatgattctcctttttcaaatactgattcatcatcctcagaaattcccatttctaatagtctatgtattgttttagcttctctccctgttgattcagtcatcctctttgcagctcttcctgttggtgccccaagtattactttcattccattattctcatatatatgtattattgcctttataattgtagtcttccctgttcctggcccaccggtaattatttctataccattattaaatgcgccaataattgcttctctttgtgattctgcaaattttatattttgttccttttcaaaaacgttaatttcgaaatcaatatccgagtttatagtctgaatttgctgcaaacctaaagttattattttactagtaacacctagctcgcaataataatattgaagcaaaaatccgacttcagtaccgtttatgttttcaacaataattttttgttgcgcagccatgtcatatatatttttttcaattaattccttagatattaacaaattattttcgcattcttctattatattatttttaggcataaatgtgtttcctgcagagcaaaattgattcataacatatttaatgccactttgaattctaaactctgaattcttttcaatgccaatgctcatagcaattctgtcagctgttttaaacccaattcccgatatttcatcgcataatatatatggattatcagatactatctgcctcgcatttgcaccaaatttcttatatatttttacacactgattattagtgactccgtgtttatgaaaatataagattatatcttttaaaccttgttgctctatataggattcatatattatttgaaatttcttttcccctataccctctatctccataagcctctcaatatggttttccattatgtctagagtttcttcaccaaatctctctattattttcttagccgtaactggtccaattccatgtattattcctgcacttaaatatttttctatgccatctaatgaatttggaagaagttcttcataatcctgaatattaaattgattaccaaattgtttgtgtactgtccagtatcctgttaactttacattttgtccttctctcaagaaaggaactgttcctacagcactaattaatgtcttttcgtttctaattctacaaacgacataaccagtatcttcacttttaaaaacaatattctcaacaaatccatttagaacttccatatagaatctctccaaatctttatatatttaccttaaactttctaaaattaaaatttagcgtcaaatttaactttgattttttcttataattatatcataaatatttataccaatttaaaactaatcacttataactcataatcttttcttattcttccctacataaaataacttttaaatggagtatacaaaataaaactataaatatttaataaattctaaagtgctcagattttaagtgcttttaaatgcttatctgttttgcaattaaagttataaattttaatcttatttgagcactcaatctattaaatttctatatatactattcaaatatataattataaatttctccataataaaaagccgtctagatttaagacgactttttaccattctacaaaaacttctattatatatattgataataaaaattcacttaagaattatactatagattttttcttatttcatctactttatttagttgttcccatggtaagttaagatcatttcttccaaaatgtccatatgcagcagtttgcttatagataggtcttcttaagtcaagatctctgattatagctcctggtcttaaatcaaataccttctctactacttcaacaatcttatcttcatctacttttcctgttccaaatgtttcaacttcaattgaaactggctttgcaacaccaattgcatatgctaattgaatttctagcttatctgcagcaccagctgcaactaaattcttagcaacccatcttgcagcatatgcagctgatctatcaactttagttggatctttacctgagaaagctccgccgccatgtctgccatatccaccataagtatcaactattatctttctacctgttaatcctgaatccccttgaggtcctccaacaacgaatcttccagttggatttatgaaatatcttgtctcactgtccaataattctgctggcacaacagcctctataacaaacttcttaaggtcttcctgaatttgctctaaagtaaccttctcatcatgttgtgttgatataactatagtatcaattctctttggcacattatcttcatattcaactgttacttgagttttaccatctggtcttaagtaacttaatgtaccattctttcttacctctgtaagtcttcttgataatttatgagccatatatactggaagcggcataaaatcttcagtttcattagttgcaaaaccgaacatcattccttggtctccagcaccaactgcttcaacttcatctttttcacctttttttgactcaaatgcttcatctactcccatagctatatctgcagattgttcatctatcgatgtaagaactgaacatgtatcacagtcaaatccaaattttgctctatcatatccaatttctcttactgtttctctaactaccttaggaatgtcaacataacaatttgttgttatctctcccattaccataaccatacctgttgttgtgcaagtttcacaagcaactctagccattggatctttagatagaatagcgtctagtatagcatctgaaatttggtcacacattttatcaggatgtccttctgtaactgattctgaagtaaataatcttctcatatcttttctctccttagatttaaatattataattatcttcacgaataaaattattttattaaaaactatacatagctttatagaataataatcgtttataaaaactttaccttatttaaatacaataaataatagtcaaactattttattaattgtttcttttataatttaagcatgcgcaaacttaaaaaaataaaaaagctcttcgataagaagagcgcaatttagcaatcattttcttatcttgtagaaaactctacaggaattggcaccttatataatacaggttgccgggtttcacagggccctttccctccacctctcttgataagagtaacataattcaattttcaaaagtattttatcatatgctgtataattagtcaatattatcaatcaatttttatataagataaaaaataaaaaagaataaacttaagtttattctttttggtggaggaagatggattcgaaccatcgaaacgaaacgtaacagatttacagtctgccccctttggccactcgggaattcctccatattattttattggagctggcaataggaatcgaacctacaacctgctgattacaagtcagctgctctaccgttgagccatgccagcatataattattagatttagtaattttataatggtgggcacaacagggctcgaacctgtgaccccctgcttgtaaggcaggtgctctcccagctgagctatgcgcccattataaattggtggaggaagatggattcgaaccatcgaaacgaaacgtaacagatttacagtctgccccctttggccactcgggaattcctccatattattttattggagctggcaataggaatcgaacctacaacctgctgattacaagtcagctgctctaccgttgagccatgccagcatatatattagattagtaattttataatggtgggcacaacagggctcgaacctgtgaccccctgcttgtaaggcaggtgctctcccagctgagctatgcgcccattataaattggtggaggaagatggattcgaaccatcgaaacgaaacgtaacagatttacagtctgccccctttggccactcgggaattcctccgtatttattttttataccttgttgcctcatttgccggtcaacaatgattagtatatcggtaaagcgattttatttcaactccaatatacacccatatagataatttaaattcatattactctctatttctacaacatgctctcatttaatatgttaatcctaattattttttattcttttgttaatctcttgtatatctaaaaaagaagatgatatttcttgaattttcttataatcttctgttgttaatctcctttttaagattttaaatatttctattaggctttcattatcattcgtatcttcataatattcttttattttacctatatcaaatgcagataatttttttattattttttcaagttcctttttattatctgtagataattgacttaacgctttttctttatttattttatataatggcttcgaatacgaaacagtttcttgtacaacaacttcttttgcagaattttcatcttgcggttgccaatataacagaaaatacatgtttattattattgtaggaactaaaaccaaatacattaaaacttttttcatatgcacctccttatttactattaatttccaaaaaacatttttttatactatcttctgttaattactcatatatatattttataaaggaggtatatgtcccttgagcaagccagatattaaacttgatcctaaattttattataatttagctttagaagttaaaaaatttatatcaaaagacaccataatagtttgtattggtactgacaaatgtattggggattgcttaggtcctctagttggatctatactcacagaaaactttttccctttacctgtttatggaactttatcttctccaattcatgctttgaacatagatgaacgcttaaatgaaatatatagtaatcaccctaatgcatcaataattggtgttgatgcctgcttaggtgacgaagatgatattggtgaaattcgtataagggactatgcaatacatcctggtaaaggagtcggaaaagaacttcccgaggtaggaattgcatcagttataggcattgtggactctagtgataatgctgaattctttttttcgcgaagcataagactctcattcattatggatatggctaaaattatatccaaaatatttattgatgcctatagtttaagtcacgggaaatatcctaaaatttaggtattttatatttaactaaataaacagcagtcaatagtaaaattactaatgactgctatttataaagctattctataagaactatttgctgagaattaacttgactatctaatttatctatataattaagcactttgcctgtaccgttcgcaacacattcaactgagttttcggctatagttgctactacgccagtcttaaactctataagtttatctaacccatgtattaaagctcccccaccagtcattaatattcctctttctattatatccgaggctaattcaggcggtgttctttctaataccttttttacagtatcaactattatttccacaggttcctttattgcatttcgtatttcttctgttgtaatttctatttcatctggtaatcctgtaatgaggtttctacctttcatcatacaagttagatttctagagtttttaaatgctgatccaatatttatttttaaatcttcagctgttttctcacctatcattaatttatattcattacgtacatattttattatggcttcatcgaacttgtctcccgctacttttattgactctctttctaccactccacctaatgagataacagcgatatcacaagtacctccgccaatatccactaccatacatccattcggcttagtaatatctaatcctgctccaatggctgctgctagcggctcctcaattaaatggaccgtttttgctcctgaattcatagctgcatcaataacagctctcttttctacttctgtagcttgagatggtacacaaacaattactttaggtgcacttatacttcttttcccgcacgctttttttataaattcctttagcattttttgtgttatatcgtaatcagaaatcactccatctcttaatggccttactgcaacaatatttcctggggttcttcctatcatttttcttgcttcttcccctatagccaacaatttattattatttttatttatggctacaacagaaggttcttttaatattacccctttaccttttacgtaaactagtacagttgccgttcctaagtcaattgcgaggtctatccccgttctccaaaagcacattttttattcactcctataatacatattaatacctatacttacataattctactaataatatattatagacttaatcctactaagattcaataattttatacttcatttgtgtagcttttccacctctaatatgtcgttcagctttatttaattctaaaatagaatgagtttcttgagcaatttctgggttaatttttaacaatctctctgtcatatctttatgaattgtgctcttgctaacaccaaaaaccttagctgtttttcttattgtagcttttgaatctatgatatatcttgcaacatctaaaactctttcttcaatatagtctttcaaaataccacttccttgattttatcattttattatcatttattttttgatttattagtcatttattttaatgaaaaaaacaaatgactaatatatattttcataaaattttatttagattttaaattaaaatatttttctggattaacttgttctccattagcattaattacttgtaaatttaaaaattcaccaaacacatctttactaaatacctttgcgctatctcctacttttgcaataacttgatttgctttaaccttatctcctttttttactgataagtttgcatcaagatttccgtatcttgtctttaggccattagcatgtttaatttctactacaaccccttcttcaacaccagtattttctgcaacttccacaacaccatctgctgctgcctttacttctgatcctactgttgattgtagattaatacctctaatagttctgaaaactccttcttccatcttaactggcgcaggataagtatattttctactttctactccatctataggatttacaaatgttaccgtattatttgtagatactgatgcagccttttctgtttttgttttatctgcattgtctttattactattattttgagcattctctactctttcagcattttgaactgaattattagaatttccttcatttccagaattcattgttagatctttatttacgtcttctgttttattaacttggtttttgctgttgagcattttataagagatagttccaacagttactacaatacagagacataggaataaggcgatataaaatccctccttcctaaataagtttttaagtttttcttttaaatttttgtccaatatgaacacctccaattgttatagttccctttttatgaaaaataatacataaatttgctttttatcatgtattatttacatttaaaggtattttaaaattatttttataagtgtatatctagtgttaaaaagtacatataatttaattattaaacaatagatatatccatcagggatttaggccctaatttaagaagttctactttataatttctgttttaagtagtgatgttctaaattatgtccatctccactttttttaaacatacatatacaaaaattcaattaattggaggatataccccatgctaatttatagtcaaaaatagaaaaggatacttgctataaaaaaataaacaagtatcctctttaaatttattcaattattcatatgaagttatgccaaccctatgtctaagttaacgtaaatactctctccttagttgtaatttatttcttggatttcgactccgctatagtaatgtttaagaatttcatcatacttcgatccactctttgccatcgcattagccccccattggctcatccctacaccgtggccataacccttacagttaacttctacagaatcttgttgaaagtctaatgtgaaattggtcgaattcaaattgaacaatgtcctaaattcagttcctttaacaatctcattgcctatttttatttcttttacacttccagcttctgtaaaacttaatatcttaattagtgatgacaaattacttttattagcattaacacctttatatttagaattaattttatttataaaatcgtttataggaatttgtgtgctcgtcttatatttaggtgcaatttcttcacccttactgtcttctgattttaaatatggtacatccatagaaaatacatcttttgcatcttctgtttttccagagctggttgcaaaaaattgaggatattccaacactgaaccgtcataagtaagaacctgcccttttgtatctagaactgccttttgtatcttctcccaattactttcagcttcacttttactccatttagagattctctcatccttactcatatatacttggcagtgggttgtatcacaaatttcagctcctttctctttttcctctttattagggttatttcttttactcatataaaatgttcttgctgcaacagcttgagctttcaaagcttcctcctcaaaattagctggtacttcactcgcaactactcccattacatactcttccaaatctatttcctcaactctatcttctgacctatgatatagcttaactttaccattagacggaaatgttatttttgaactcttcattatatctttgtcactcaagttaaacgaatcaattttccctttaccattttctaagaaagctattggtaatgctattaatatagtaaaaatgatcaaagtcatagctgcaattattttcacattattgctaatctttatacttgtagtcctagcattaattatcttcatactctacctcctaaagcctgcactctaaagtatattgtcttagcctaataattatgttaattatgttaactttaagctacccaaatttagataaaccataactttcttaattggtctctcctataacttacgcatagatttaacttaaatataagctattagagataaaaaaatcccaggcgactgtggttaagctccgtattgtgcttcgcactcttttcatttaagttccgtattgtgcttcgcactcttttcatatgtgtagatttttttcacgcatctagcttttcgaacgcatgtgagaaaagtcaggcgaataagatttctttttttattctttttaaaatacccaaactatttaatcaaccttttttaatttatcccctcaaggagtacctcgtccacagattttactgaaatataaattcccaaagaataaaaaagcataattagggataggtaattaaatttcatgtaaattcctttataaaacttacatgaaaaatttgtataccttgttcataactatgaaccctaattatgcatacacacaattcatatcttaatctacatatttattctatatatttctgctcctaaattcctaaacttttcttcaattcttacatatcctctatcaatatgataaacatcatttaccactgtttcaccatctgctactaatccacttagtatcattgctgccccagcccttaaatcagttgctttaacttcgcagcctgtgagtcttggcttgccttcaattatagcagttcttccatcaatcttgatgttggctcccatcctttgcaattcagcaacatgcataaatctattttcgaaaactgtttctgtaataacactaacaccttcaacaatagataataaactcatcatttgagcttgcatatcggttggaaatcctggataaggaagtgttttgatatccaatggcctcttacttccccgtccatctactacaatggaatgatctttgtaattgctaaaacctattccacattctcttaacttttctattacaggtcttaaatgctcttcattcactccatttatctttattttactatttgtaatagctgctgctatcataaatgtccctgcttctattctatcatatataggtgtataactaattccttttagatttttaacaccagttatagttatctttccaaatcctgctccttctattttagcccccatcttatttaagaattgcgctaaatcccagatctctggttcttctgctgcattctctattatagttgttccttcagcaaagacagataccatcataatattttcagtagcgccaacagatggaaaatcaaggtaaattctgttgcccactattttctttgctctcacctctacaaacccatgacctattacaacctctgctccaagtaatttaaatcctttaagatgcaaatcaattggtctacttcctatgttacatccgcctggtaatgataatttacaatatccaaatctagcaagcataggtcccataattaaaaatgatgctctcattttcctcataagctcttcattagcatccatttctactatatttttcgtatttattgttaatctatcgtttacgtttgaaatattaacgtcacagtttagttcgcttaataacttacaaataacctcaacatcttctaacctaggtgcattatcaataattataggctctgggcacaatatagttgccgcaattattggtaaaattgaattttttgcacaacttatattaacttcccctctcagttcttttacacctttaaccactattttctccatattatcctccataatgaattgttaagcatatgaaaaataactgtccaaaatattacatatactctactttaaataaatccaataaggctttgctaataagcaaatctatactctacccaaagcaaaataaaggttatattgaaaagctttttcaatatgtcttaatatgttgtaaatattattggcgtaccaattattatatgtgaaccagtatcataatcaactaatgcaaaattaattttttctccatcgttcaaataacctgttcctgagtatccattactgattttcataagttgtgccttccttatgttatattcactgactaatccatttgtaaaataatcactatctaatcctttttctttaccttcatagtaaagaaaatattgcatattttctaattttgaattttcaatattcttaagtatgtttttcaaatactttgtcccatatttaggattcttgtttgttaatataatttcaacataactatatacatcttcacgccatatttttatatcaatattaaaatcactattaaacgcttcaaactcatcatttccaccatctttataagaaagagccatatttctaggtaaattttcttttattctataagcttcatttgcaatattatttttcgtcctatactgaagttttacaccattttcttgaaactcacttatatctttcactttcatttctaaagtattgaatgaattttgagcgctgactatatcgctggaaatagcacctatattaaaaaaagataataatataaaaattactatactcatttttatattcatattaagacccccttaatttatcttcttaattatggccatctcctttaacttttattctcttttctatcaagctatataatatataatataaatttcttaaaattttgtgatagattgtcaatatctagaataaaaaataataaaaaataaagtgtagcatctttatacggatatttcctatataaaagatggtacactttaatttatagtaacattatctattagatttttttagagctaatctttgctttgccctaaagaatgctgcctctgctcttcctctattgtagttttcggagttttttaatctatcttctgctcttctaaaagctcgttctgctctttcttcatcaatatcctcttcaaactcagcagcatcactacttataaccatttcgttattattaatctgaacaagtgacttagaaataaataactcttcatcatttcccttagcatctttgaatttcgcgatgcaaggtatagtagtagatattagactttgatgatttgcaagtacttgaaattctccatctgcactttttaaagttactttttctacttgatcattatacacttcacgaccaggtgttataatttttagtaaaaaggtattagccataattgctcatcccctttatcctaatttttttgctttttctataacatcatctatagttcctgcaaataagaaagctgattctggcaattcatcgtatttaccttcaagaatttctttaaatcctcttactgtttcttttactggaacatacttaccttttaatcctgtaaattgttcaccaactgtaaatggttgagataagaatctttgaattcttcttgctctagccacgacagccttatcttcatctcctaattcgtcaacacctaagatagcgatgatatcttgtaattgcttatatttttcaagaacgtgtttaacatcagctgctactttatagtgctcttctccaacaattcttggatcaaggattcttgaagttgattctaatggatcaacagctggatatataccaagttccgcaatacctctagataaaactgttgttgcatctaaatgtgcaaatgttgttgctggagctgggtctgttaagtcatcggctggaacatatacagcttgaactgacgtaatagaaccattaactgttgatgtaattctttcctgaagtgcacccatttcagttgcaagtgttggctgatatccaaccgctgaaggtgttcttccaagtaatgctgaaacctctgaacctgcttgagtatatctgaatatgttatctatgaatagtaacacatcttgacctttatctctaaaatactctgccatagtaagacctgttaatgcaactctcattctggcacccggtggctcattcatttgtccaaatactaatgctgtcttatcaataactcctgactctctcatttcatgatataagtcattaccttctcttgatctttcaccaactccagtaaatactgataaaccaccatgttgtttagctatgttgtttattaattcttggattaaaactgttttaccaactccagctcctccaaatagacctatcttaccacctctttgatatggtgcaagtaagtctactaccttgattcctgtttcaaacatttcaggctcaactgattgatctttaaagcttggtgctggtctatgaatcggatattcttgttttacttcaatatccccgcacttatcaataggctttcctaaaacattaaataatcttcctaatacttcttctcctactggaacagaaataggtgctcctgtatcaacagcatccattcccctctttaatccttctgtagctgacatagctattgttctaactatatcatctccaacgtgttgttcaacttctgctactaattcataatctcccgccttaataacaatggcattatataaatctgggagagaatctgaatcaaactttatatctattaccggtccaattacttgaactacttttcccatctttccaggcataagatacctccttactaattttgagctgctgctcctccaacaatttcagatatttcttgcgtaatcgcaccttgcctaattctattaaatttaagctttaatttgtctaatagatcatctgcattctttgttgctccgtccatagctgtcattcttgtactttgttcactacatttcgaacttaataaaatgcttctgatttttccttttagataaatattaagagcatcttctaatactatatctaaatccggctcaataagaaatgatcctgttgtgccttcagatttacttataggcaaaatcttaactgactttgtttcttgtttaactgatgatataaagtcagagtatacaatattaacctctgatacatcaccatttaaatacatttcaagagctttatcaaatatttcttttgcttcgcttactgttggcacatcttcaataccaacatattctcctactggttctatcttaattctctttaaataaccaagacctttgcttccaactaaaacaatctttgcagtatcctttttatctttaatttgacttactaattgagatactacactactgttaaacccaccgcacaatcctgaatctgatgttattactacatatagtttattttgactatcattcccttcaaaataaacattgcttccttcttcaccagctgtagttgcaagatttcttacgacaggttcagttatatcaataaacttattgtttactgctaactcatttttagtttttcttaacttagaagtggcaacaagtcccattgcattagtgatttttcttgtattttcaactgatttaattctctttttaatttcaagaagtccagctgcgcccattatctccacctcctaagaagggcatagcttaagaatttaagctatgcttcttgtaaaaatatctttttaaactcaactattgcttcctctaacatagattttatttcatcagttaaagtttttcctgtaataattgatttttcaatttctctatgatgagtatcaacatactctaagaattctttttcgaatctctttatatcgctaactttaatgtccgataagaaatcattaacagctgcatataatattatgatttgctttccaacttcaagtggactatattgatcttgttttaatacttcaactaatctcttacctttttcaagtcttctactagaatcggcatctaagtcagatccaaattgtgaaaaggcttctagctctctatattgtgctagttccaatcttaaagtaccacttacctgtttcatagctttaatttgtgcactaccaccaactcttgatactgatatacctgcatttactgctggtctttgtcctgcattaaataaatcagattctaagaatatttgaccatcagtgattgatataacattagttggtatgtacgcagtaacatctccggcttgagtttctataattggaagtgctgtaattgatccaccacctaattctttagatagcttcgcagctctttcaagtaatcttgaatgtatatagaaaacatctcctgggtaagcttctcttcctggtggtctcttaagtaataatgacattgctctatatgcagttgcatgttttgaaagatcatcatatattattaatacatctttaccttgatgcataaaatattctcctatagtacatccagaatatggagccatatattgaagtggagctgattctgaagctgtagcacttacaactatactataatccatagcccccatttcagttaatgtattaaatatatgagcaactgtagattgcttttgaccgatagcaacatatatacatataacatctttacccttttggtttaatattgtatctatagctatagctgttttacctgtttgtctgtctccaatgataagttctctttgtcctctacctattggaatcattgaatctatagctttaattccagtttgtaatggctcattaacagaacttctatcaattatacctgctgctggaatttcgattgctctagtttggcttgtgcttataggtcccttaccatcaattggttctcctaatgcattaacaactcttccaatcattgcttcgcctacaggaacttcaacaactcttcctgttcctttaactgtatcgccttcttttattcctttttcttctcctaaaagaacacaaccaacattatcctgttcaagatttaaaaccatcccatatacattgttaggaaattctaataattccccttgcatacaattatctaatccataaactcttgaaacaccatctccaatttggattatagtaccagaatctactgttttgatatctttttcgtatttctctatttccttctttataatagaagttatttcttctggtttaatattcatggattcacctctattctttcttaagcattaattctttcatttcttctacctttgattttatagttccatcaataatatcatttccaactttaacataaactccgcctaagagacttttgtctattttagtatcaaataaaatatttttttcgtactttttctcaaagatagcttttaattgttctaactcttcatctaaaagtggtacaactgttttaactatacctcttatagtatttcttctttctagatcaatcttttccatttgatctagtatttctcttaactgaagaattctatccttttcaatcaatatcatcatgaaagaaagtaattcttcatcaatttttcctttaaacaaatcagtaaataactgtttcttttttgctgtgtttattttaggatgattaattacttcataaaactctttattttcatcaaatatatcacatatatctgttaagtctcgtaaatattcatccactttattgttcttttcagcaatttcatacagagctaacgcatatcttttctctaaatactcctgcatacttacatacctaccttagcaataaaatcgccaataagttttctatgtgttgcttcatctacctgctgctctaatgctttaactgaaagctctaccgctaaatctactgcttgttttttaatctcatattctgctttttctttttctctttcaatttctaagttagctctttcttttactgaatttgcttcaacttttgcattttgaacaatttcctcgtaaagtttatcaccctttgctctttgagcttcagtgattttcttaccttcttctttagctgattgtaaaatttgttcattttttaccaaatacattctagctttttcagcatcttcatctgctttacttatcgtttgattaacgagattttgtctttcttcaattattcctttgattttatcccaaaagaaatgttttaaaatcaagattatcagaccaaaattaatccaattgaatataactgttgatacatttacttccatttttacttatatcctcccttcggagtcaatgtaattaactcatgcgaatttattatctgcccattaacataaatgccattactaatccatatattgctgtagtttcacaaagtgctgcacctaatatgaaaaatgtcattactcttcctgatgcttctggttgtcttcctactgcttcaactgccttaccagctgcaattccaatacctactcctgctccaatacctgataatacagctataccagctgctagaactcctaaactcattatgattcctcctaagatattaattaattttaattttttaataatttttaaacttattcttctgctatttgtttgatattaatcatagttagcattgtaaatactatcatttgaattaatccatcaaataaatcgaaatatgcgtgtaatattaccggtataccaaactgtgcaaaaattgatattgaactcaatccacgatacaccaattctaataatattactgccgcaatcatgttaccaaaaagtcttagcgccaaagacattggcaaaataattctttctattatgtttaatggcagcatagggataaatggatgtaacaatccctttccaaacccaagtattccattctttctaatagcatttaaattcactactaaaaatgtggttattgcgaaggatgctgttatactcaaatcacttgtaggtggcttaaatcctaataatccaactagatttagtattagcaaatagatcattaatgttcctatataaggcagaaatgattcatattcttcacccatagtaccaaccataaagtcccttattgtttgatagactttttccaaagccgcttgggtcttgccaggttttaacttcaagttttttgttaatagaaaagcacctatccctaaaattgcgataacaatccattcaattattatccctgcagtaatatctactgtaacgccaaaaatttcaggtgaaaatataggtatcacgggctccactctaaacacttcctttcctattttctttaatacgaaaaactataagtagtacataatgtgaaacaaagcctatcatataatatattacgtattttatatttcctaaaaacggaaatactgtagcaattataaatgccatcctaataaaatacgtaggaattataatccacgctctatttttatccaaaaactttccaacaatatagccactagctagaaaatttattaaagaaacacacatacctatcatatagattcctgcatttataaaggtggaaattaagactattactaaagatatcaataatccgctccccaaatcatattttatcgtttgtagaagcagtttattcacttctttattcatacataacccccttaacctcaatatcagtaattatatctttatatttatctttaataaaacactatttgaaagtaaaatcagcttatttttactttataatgaatttatactgcatatactcttaaatgctcagctaatattggttatttcttcatttttctcatttaatgattttttaaaacttgttcaattcacttttctgaatattctgtaacatttatctacaaaatattatttttgttaacattttcattacaaattttgtcatcaattttcaaaaatttggtgaaatttatactatttttaagttttataaagctatacttactattatgtatttcatattattgaatatagaaattaatccttattcaatatttattttttttcaatctacaattaccaaatttatatgtattattttttagcaaatcctcgcattaactatgttatgaagtatgtaaaacaccttaatgaaatatatgattaaaaattctttcattttttccaccggtttatatatagtaattattttgataatatttttaccccttgcatcagataatgaatatacataataatttcattttccactggctctatataatttaatacatgcatttctattttcttcttttaactttattttatactcttatttaataaaaaaaggttaccatgagaattatcatagtaacctttttaaatcttaatttatattaaattctttcaacgataagtgctgttcccattccgccacctatacaaagtgtagctaatccttttttagcatctctcttttccatttcatgaagaagagttactaatattcttgcacctgatgctccaactggatgacctaaagcaattgctccaccatttacattaacttttgacatatcgaattttaaatctttagcaactgctaagctttgagcagcaaaagcttcattagcttcgattaaatctaaatcttctactgttaagttagctttttctaaagctttcttagttgcatggaatggtccatatcccatgatagctggatctaatccttttgaaccataagaaagtattttagccattggcttaagtcctaattcttctgctttttctgcactcataacaacaaaagctgctgctccatcattaatacctgatgcattacctgctgtaacagtaccatctttaataaatgctggctttaatttagctaaagtttctgctgttgttccgaatcttgggaattcatctgtatcaaatacttttggttctccctttctttgtggaataacaactggaactatttcatctttaaatcttccagatttaattgctgcttcagctttttgttgagatgcagctgagaaagcatcttgctcttctctagttaatccccattgtttagcaatattttcagctgtaactcccatatggtagttgttaaaagcatcccataatgcgtcttttatcattgtatcaactaatttaccatcgcccattctttgtccccatcttgctttgtccaatgcatatggggcagctgacatattttccatacctccagcaacaacaacatcagcatctcctgctttaatcatttgtgctgctaaactaactgctctaagacctgatccacaaaccttattaatagtcatagctgaaacttcttgtggtaatccagcttttattgttgattgtcttgcggtattttgaccaagaccagcttgaattacattacccataataacttcttcaattaattcaggttttactccagctctatttacggcttctttaattactaaagctcctaaatctactgctgagacatcttttaatgctccaccaaaactacctaatgctgttcttactgcacttacaataactacctctctcatgtttgacctcctaaaattttatagattattttattaacttttgttaaattattaacataactaaattataccttttattatttcttttatcaagcataaattgttaaaatttaaacaaactttatcttttaaattcttctacttctcttgttgtcaaaccaaaatattttaatatagcatctgctattcttctagatgcaattccatctccataaggatttatagatttactcattttacaataagcatcagggtttctaagtaactcgtttgcctctgatactatttgatctatattagttccaaccaacttaacggtgcctgcctctacagcttctggtctttcagtaacgtctctcaacacaagtacaggctttgctaaatgtggtgcttcctcttgcaatccccctgaatctgtcataaccataaacgatttattcatcaaattatgcgtttccttagtatctaatggtgacagcaagtgaattctttcttttcctccaagtctctcataaactacatctttaactacaggattcaaatgaactaagtacactaattctacgtcttcattctgttcaactattttgtttaatgctatacatatattttggattccttctccccagttttctcttctatgagcagtgatcattattactttcttactaaaatcaatattatttaactcctcgttttcaaagatgtaatcatcttcaactgtatgtttcatagcatcgattacagtatttcctgtaacatatatatcactcgcatttattccttcccttagtaagttttccttcgaacctttagttggtgcaaaatgtagatcagctagacttcctgtaagttttctattcatttcctctggaaaaggaaaatacttattaaaagtccttagacctgcttcaacatgcccaactttaatttgctgatagaatgcagctaaagaacctgcaaatgtagttgtagtatctccatgaactaatatcatatctggcttttcttctttaaaaacttcctctaacccttctaaaactctactcgtaattcctgttaaagtctgttttgtcttcattatatttaaatcaaaatcaggttttatatcaaataattccaaaacttgatctaacatttctctgtgttgagctgtcacgcaaactttcgattcaatctcttctcttctttctaattcctttactaaaggtgccatttttatagcctcaggtctagttccaaaaatcgtaataattttctttgtactcaaattatttcctcctatatttaagcaattatagatttttctcattctatttctaagtactgtctttatgtatatttaaaatcaagttaaacttaattcaggcgtagtttagtctccatctgaatcttagttgaaacttatccagcgccgtacagccgttatctcctcattaaagaaaaaagcgtattacgcatactatctatctggtaaagtttatactttaaaaataaatccaactcgcaatgcttgttggatttattcaaatatgcaaattctaaaaaattaataccctgcgtcttttactattcttagagagtcatcgtcttctatccatgaatctacacttatttctctatactcctgctttgaatcccttataataacattagaaattccggcattaattatcaatctcttacacatggagcaagagtttgcatcccttacatattctcttgtttttgcatctcgtcctaccaaatataatgtagctccaatcatatctcttctagaagcgcttattattgcattagcttcactatgtacactcctgcacaactcataatgagtacctcttggaactttcaacttttctcttatgcaactattcaagtccatgcaattttttctacctctaggtgctcctgtgtatccagtagaaattatttcatcatttttaacaattatagaaccatagtttctccttagacaagttcctctctctaaaactgtttcagcaatatccaagtaataatttttcttatctcgtctctccattttctatattccccccagtaaaattatcttgggtcattcagaaacttatgtagatagcttttaattctaataaattactaattacttagtaccaaataatctatctccagcatcaccaagacctggaacaatatatccatgttcatttaatttttcatcaattgatgctaagtatatatcaacatcatcatgtgcttttttaatagcttctataccttctggtgctccaaccaagcacattaattttaaattttttgcccctctattttttaacatagttaaagcatctattgcagatccacctgtagcaagcattggatcaactactataatatctctttctgcaatatcttgtggcattttacaaaaatattcaactggttgaagtgttttctcatctctatataatccaatatgtccaaccttagctgccggtattaaattaagtactccatcaaccattccaagaccagctcttaaaataggaactacagccattttctttcctgaaagcattttacatttagtaactgctactggtgttttcacttctacttcttccgtatttaaatctcgtgtgacttcatacgccattaacattgagatttcttctactaattttctaaaatcctttgaacctgttttttcatctcttaagattgccaacttatgtaatattagtggatgatttatttctataactttgctcattattattcctccaagtttgcttttagtatttatagccctttatatttatataccccatttagctttctaataatataaattaatattgttgtagcatagctgcttttttctaatctaaatgatcttggttgcagcatagctgcttttttctaatgtgtatactttttttcaatatctgaaatcttatctattcttttttggtgcctatctccttcaaatttagctgatataaatgtttttactatatctaaagcaagacctgctccaacaactctttggcccatagttaatatattagcattattgtgttctcttgttgcatgggcactaaatgtatctgaacatagtgctgctctaattcctggtaccttattggccgcaataccaattcctattcctgtaccacatattaatataccaaactcatattcctttgcagcaaccgcttctgctactggtaatgcaatatccggataatcgcaagaacctgttgaatatgtaccaaaatccttaatctcatgcttttcactttctaaaaactttatgatttcatttttaagttcaagtccaccatgatcgcatccaattgcaattttcataattaaatcatctcctaatttattttgtgatttttcaacatgcataattattatacatttatgatatcaaatccagcagctttatttaatctattcataatagctacccctacacctttttcttcatatccttctgcaaaaactaaatccgctcctaggtcatcacactttctcaatgcttcaaataaacttctagcaactgttgataaatcacttagactacccaatactatactagttccttctgtatattcatcaacattttcttcaacagtgaggatacatacttttttacctttttctatattatagtgtaccatttcacggattttttcaatagttttttttctttccccagaaattattgtaactttagcatttggtgcataatgcttatacttcattccaggagcctttggctttaagttttcgcttggtttttccattatagctttatctatttcaattcttgggtcaacttctctaagcatctctaatgtaataccacctggtcgtaaaactataggtggtactactgtgcaatccactatagtagattcaacacctatgtcactctgttctcctccaagaatataatcaaccttcccatcaagatcctctatgcatctctgaaaatctgttgggctcggtctcccacttatattagcagaaggtgctgctatagttgtctgagataattcaattagttttctagctacttcattatcaggcattcttattccgatagagtttaaattagcacttgttacattaggtattatatctttcttactcaaaattattgtgagtggtcctggccaaaatctatttataagttcatcagctacttttggtatttcttttgcatatagatcaagtttcttcgacgaaacatgaattatgagtggattatcttgcggtcttcctttggccttaaatattttttctaccgcttcttcattaagtgcatctgcacccaatccataaactgtctccgtaggaaaaactacagtaccgccattttttatacattcagcagcttctcttattttctcttcatcctcactaacatttttgatcatactaattttagttttcaaacatattaccttcttcccctaattctaaacttattgtttataaaaaaattcctgattaaactataagctggcctcttgatatttttatattttgtatactttcatcagtgtaaatagctttaacgcaattcctatatattgaatctaataataaatacttctttagtccacctctttttattacttgaaaataatactctttctgagaatttaattgttttatagaattataatcttcaataatttgtggatatcttcttaaaaacccatcatcaacaggtctcaatcccttatttttaaaaacaacatttgttattaaaactatttctaaatcatagtcagatttatttgtatgtaccagtacaactttatcacatataattaagtattctttaatggaaataccgaccttgaaaatcaacctattatttaagcacctatattcaacaatataggcattcatcttaattataatagctataactattaaaaattctataaaaatcacataactaatataaaaaatagtagttaatccggttattattagaactgttggaagaaaaaacgcaataataaccatggtaattaagaaaatttttaaatgtaatcgctctttttttacagccttatatatatccataatcaatctccaatgtacttttaaagccctacatatataaaatgcaaggctttgctttatagttattacatttgtgtgtttcccattaatttcatcttttcagcttggtcagctgtaataagtgcatttatcatttcatcaatatctccacccaaaaatgtatctaacttatataaagttagtcctattctgtggtctgtaattcttccttgaggataattatatgttctaattctttcacttctatccccagttccaacttggctctttctgtcttctgctattccttgtgctctttctctttctgcctgttcatataatcttgattttaaaactttcatagctttttctttattttttaattgtgacttttcatcttgacatgaaactacaagccctgtaggcaagtgagtaattcttacagccgagtctgtagtattaacgcactgtcctccatttcctgaagctctaaatacgtctattctaacatctttatctgcaacttctatttcaacatcatcaacttctggtagcactgctactgtagctgttgacgtatgaatccttccacttgattcagtatctggtactctttgaactctatgaactccactttcatattttaatttagaataagctccattaccttttatcataaaaacaacttctttaaaaccaccaagatctgtttcattcaaactcatgatttctacgccccatcgttgagtttcagcatatcttgtatacattctaaataaattgtatgcaaatagtgcagcttcttcgccacctgcaccccctctgatttcaacaaatacgttcttatcatcattaggatcttttggtaataataaaatttgtatttctgtttctagttgttcttctctatttgtgagatcagttatttcttcatttaacatttctctcatctctttatcgctttcaccgcttaacatttctttgttagcttttaaatcttcaactactttcttatattccctatagctattaactataacttctaagtcagcatgttccttacatagttttctccattcattctgattctgcataattgatggatcacttattttcactgataattcatcatatttgttttctataaattctaatttatctaataacatttgatcactccgtacttcttttttcacatttctacattatatcatattttaattacttaaccaactaacctcatttataaattatacatcctatgacttcttaattcgttcttatatctaaaagatctgtttcaattaaattttaattccaactaccaccctatcaaggctagcaaaatctttaacaattttcacattagtaaaaccgttattttccattaatagtttcaccgcttctccttgattatatcctatttcaaatgctaatatcccactttctctcaatgtatattggctttggtcaattatttttctataaaaatctaatccgtcatttccaccatttaatgcagtgtgcggttcataattctttacatcctccattaatttcccaatttcacattcctcaatatacggaggatttgatactataatgtcatatattttattattttttatcgactcttctagcaaatcactttttataaagaaaactctatcttctaacttatttttctctatattaattagtgatactttttccggaataggataatagtctattaaatcaacttttatattttgcctaaaatgtgctaatgatataccaactgcaccagatccagaacacaaatcgcatatttgcatttcttgattttcttctataattttaagaacttcatctacaagtatctctgtatcccctcttggtattaaaacaccttcttcaacataaaattcgatacccataaattcacatttatttagaatatattttactggcattttatttctacgtttttcaatcaaatcaaaatatttttcagcatcttccttacttacttcatcttctttatgtgtaattaagtaaaccctatctttctcaataatatttcctaacaatagctctgcatctaacctagcagtatctatgccattttcttttaatgtaaatgtacctgtttttatcagctcttcaatatttttatttggatcttttattccttctgctgctttcaacgatgcaatagccacttcaatttgggaatcatctggttctttagttgttaacagttgtaacttaaggccaggatacgctattatttgagctagcatactgtcatttttaccaagccattttattatctcataactaatccctgtaactactggtataagaataattctaagagctaacctttctatgattccaccccacccagtgaaagaaaacactataatactaacaaacattaccaaaaacaaaaagttagtaccacatcttggatgtaatcttgattgttttctgacgttctctacagttaattcttccatagcttcataacagaatatagtcttatgttcagctccgtggtattgaaacactctatatatatcgttaagtttgcttatagaaaacatataaagcaagagaatcactattcttataagagcttcgaccaggttcagcattacatttgaaatacctgcacctttgaaaactgatgctatgcctgttggcaatgcaacaaaaagtcctatggcaaaaagaaaagaaataaacatagttattgccattaatacactattagccttttctcccagtttgtcatctaaccatttttcaaatttagaaggttcttcattatcttcttccaaaaatgatgctgagtagtttaatgattccattccaaccttcattgattctactagtacgaaaaaacctctaagaaaaggtatatttaaaatcggatatttttttgtcactggtctattatctttaaaatctatttctatattacctttgggagttctaacagcagtcgcaagatttttacttcctctcatcataacaccttctataacagcttgccctccaacatcacgtctttccatttataaaaatcacttactctcctaattaattttctttgtatttatagtagcactctccacacaatgactcatattcaacattatcttcatcatcaattgcgatttgttctccctcaaatacaaatttattatttatttttcttccattaaacacagctttcctaccgcatgcacagattgttttcatttcttcaatactatgagccaacaataacaatcttgtactaccttcaaatccatttcttttaaaatcagttcttagaccataacatattataggtatattaatctttacagcaatttcaaacaactgatctatttgtgactctcttaaaaattgaacttcgtctactagtatacagtctattttattattttcttttatataattactgattatttgaaagatatcatcctgatctgaaactaataaatctacccgcctatttactcctaacctagatacaagtgtgtctccacctttattatcaattctaggtttaataattaccaccttcataccacgttcttcataattataagcaacttgcattaaatgagttgattttccagaattcatggccccatatctaaaatataatttactcatctgtaaaatactctccttatttaaggtatcataatcgattatatcatttaatagtgatcataaaaagacatttttatattatttacatgcatagatttattattgacgctaaaattgtactatgatataatatggtggttgttattgaataattaacatagtttatataattgaaagaggtgaaaaataatgagagaaggcatacatccagaataccaccacaatacagtggttaagtgtgcatgtggaaacactttcactactggttctgttaaagaagaactaaaagttgaaatatgctctaaatgccacccattcttcactggtaaacaaaaaattgttgacgttggtggaagagttgataaattcaacaagagattcaacattggcagcaagtaataactttatgaggaaagacgatgtctttccttttttattcatatttctaatatattagaaatatatattttactgcaattgtttgcaaacttatacatacttaaaatttaaataactaaattttaatatattagcgtatataatttaatatttaaattatatactatacatggtaaactatgtaatataataatgttgaaatgagtgactttcatgaaaaaagttttaatcttaacaacatctacaggacagggacataatcaagctgctgcttcggtagaggaatcatttaataattctggttatgagattacaaagcttgattttttagccaagaatagcaagcttcttaacgatataattgtaattggatatgagttttcggcatcgaagtttccaaaaacttatggtttcttttacaaactaactgacacaaatttaactaataaactattaaaactcatcttctttatggcaagaaagaaggtttcgaaacttataaacaaaatacaaccagatgtcatcatagctacccattcaattaatattagcgtgatttcagatctaaaaaagaatggattagatataccttttattttagtagttacagattttaaggctcattatctatatgtggattcttacgttgatgcttatataaccggaagtaactatacaaaaaaatctctagtagatagaggcattaatcccaataaaatttatccaataggcatacctataagtagtaaattttatactgaagttacatcagcaaacgatttaaaagatgatgaatattttaatttattgctgatgggaggaagtcttgggttaactactatttttacagttcttaaagaattgttaaaaaatccacacaagttaagaatcacagtagtttgtggcaaaaatgataacttaaaaaatagattaattagttattgcaaggaaaataaatttaaaaataaaaagcttcatatattaggcttcacaaaagatatctcttatttaatggattattgtgatatcctaatatcaaaacctggtggattaactgttacagaatctatagtaaagaacattccattaataattccatttgccataccaggtcaagaaaatgaaaatatagattttctgactagcgaaggttattcaatatatgtaaaagacttaagcaagctaaatgataaaataaattatttaataaataaccccaatgagctatctaaaattaaactaaagctcaaagagttatcatcaacttattctttaactaaaatagtcgatatagcagatgatttaatttcaaaaaaataaaagatggccactagaataaaatggtcatcttttttgttatctattgaatttttttctggaatacatctacaaattctttattgttgccagttttagataacatattaattaaattctctgtaatatcatctgagtttccatctctatacatctttttccttatggagaatgctacttctaattcttctttagataaaattaaatcttcttttcttgttccagacttatatatatctatagctgggaaaattcttctctcttgtagacgtctatctaaatgaacctccatattacctgttcctttaaattcttcaaatatcatatcatccattctcgaccctgtttcaattagtgcagtagctagtattgttaaacttccgccctcttcaatttttcttgctgctccaaaaaactttttaggcattataagcgcacctggatcaagaccacctgataatgttctacctgtaggagttattgtcaaattgtatgctcttgataatctagttatactatccataagaataacaacatcttttccttgctcaaccattctcttagccctttctaataccatttgggctacctttgcatggttttgcggttcctcatcaaaagttgaataaactacatctccattaatagacctcttcatatctgtaacttcttctggtctttcatctataagcaaaacaataagctttacatcaggataatttttagatatattttgagcaatcttttttaatagcgtagttttccctgcctttggtggagcaactataattcctctttgtccttttcctattgggcatattatatccatgagtctcgatgataaatcattactatcagaggtttctaattttaatctttcttttggatatattggtgttaatgtttcaaaggattttcttcctatagctttttccggatgctctccattaactttttgaacaaataataaagctttaaacttctcagtctcctttgcttctcttactttaccctcaacttcatctcctgttcttaaattgaatcttctaatctgagatggagatacataaacatcttcgctactagttaaatagtttttacatcttaggaaaccaaaactattattttcaagtatttctaaaatcccatttgcaacgttggattcatttatcatttcttttaaattttctttcttttccacattcccaatttcatttgttctagattttacttctgaatcattgctttctttattcgactcagtattattacttctaggcataacacttctagtctcttctacattcttaggtgctatattttctcttaatataacaccattcttttctataaagttactaggaactttcaatatttcttctattaactcattctttttatatttagatatatttttcacacctaaatctttagcaatatcttttaactttgttaaagtcatgctttcatattctttttttgtcaagttcgcacctccaatttatagatatgaatctataaaatcaattcttttataattttagttatattttatattggaaaatttaacagtaagatagttagaaatgatatatatttgagaatattttagaataatacttgtaaaaatacattttctattagtttagatatttatttcaaatttaatgcaatatattaaattttattttatataattcacgatcaataatttaaactactaaagttattaaaataagtttaatatataataaattataatacttattatatattaaactcaataataaaacaaattactttgatttattttcttctaatgctgctttaataaatcctacaaacaacttatgtggcttgttaggtcttgattttaactctgggtggaattgtactgcaacataccatggatgatcttcaacttcaacaatctcaactaatctttcatcaggactcgttcctgcaattttcattccagcttcagttatttgttttctgaattcattattaaattcatatctatgtctatgtctttcattgataatttcatttttatatacttcataagagttagtattttcagctaatctacaaggatataatcctaatctcattgtaccaccaagattttctatatccttttgatctggcataagatctattactggataatttgtgcctgggtttatttccgaactattcgcatcttcataccctaatacacttcttgcatattcaattacggcacattgcattcccaagcaaattcctaggaaaggcttcttattttctctcgcccattttatagctgctattttaccttctattcctctatcaccaaatccacctggcactaatattccatcaacatctttaagtaattcttgagcattactgttttcaatattttcggcattaatccacttaatttcaacattagtattattagcatatccaccatgacttaatgcttcaactactgatatgtatgcatcgtgtaactcaacgtatttacccactaatgctatcttcacgttgtttttaaggttcttaatcttttgtaccatttgaatccattcggaattatcaatatctttacatcctaaatgtaatttttcacatacaagattatctaaaccttctgaatgtagcattaatggaacttcatataaattttccgcatcaagattttgaattactgatcttccgtctatattacagaacaatccaattttagccttaacatcatctgataattctttctcagttctgcatactattatatctggttggatacctatcattcttaattcttttactgaatgttgagtaggctttgtctttaattctcctgcttttcccaagtatggtaccaaagtaacatgtatgtaacaaacattttcagctccaacttcactttttatttgtctaatagattctaaaaatggttgtgattctatatctccaacagtcccaccaatttcagttattaccacatcaacatctctatcttttgctacttggtatactttatcttttatagcattagttatatgaggaattacctgaactgtacctccaaggtattctccccttctttctttttctataacagaactatatatcttaccagttgtaacatttgaattttgagttaaactttcatctataaatctttcataatggcctaaatctaaatctgtctcagctccatcatctgtaacaaaaacctctccatgctgataagggctcattgttcccggatccacattaagatatggatcaaatttttgaatagaaatttttacccctctattcttcaataatctcccaagagacgctgctgttattccttttcctagtgctgatacaactccgcctgtaacaaaaacgtatttagtactcatttttatcctccctatgttaaaatgttcttctaaattaatattgactttttcaaaaagtcatgctataatgaaaatcaccccataatataatatggggcacttgtgttgcttaataacataggtattataatatcacatatctactccaatatctagtcttttttttataataaattggtcatgctattctttcctatattatcttctaattcaaagtacttctctctaaaaagtctatttattaataacttttcttctgctagtttcaaattgttacttatactcttagaagtttttagattaaaaacttccttaactctctcagtatctaaacagtgattatattttaataataataataatatatatttattatctctattttttagcaattctatagaattttcttcatcaattccgtaatatttgcatatgttattcaatatctctatatatttcaatccattttgcatatatattcctccctttgatattatatcccatttttttctaatttaatcaacttattcctaaatctctttatacaaagggagtatttaaataaatatagaacctacttaatttaatttcacaccgatagttaagtttgtcttcaatgcaggctgtccacctatttctagtatgtacattgcggttattgttccgccctctttactaatatcaatattaagttttttagtatctatttgaagatccataacaccgtacggcgttttatatagagatattgttctatgattatttctaaattccattttagtttctgtagtgccttctcttattaaatcaaaagaatcatttcttattattatagtagtctttgtcccttccatccctgaaagctttgtttcctcatactctaccttaaatccatcttctatttcatgaaaatctcctggagttactacccctacaagatcctcttcattatccaatacataactatccaccgttataatagcttttttcttcatattctcctccacttataatatattatatttgaatattatttttgactttcagaaataagctttagctttattaaattcatttgacaactatataaatttcgtgaataaaacttccaaatatcctattaatattatttaaatatatctcgaaatatttccactattttaaactttatctttatattatttccatctgcctgcttatccctacattttcagttgaatcgtctttagattctaattcaaaactttttccatttgactttattttattctctgttttatcatattccacttgtgcctttgattcgtctacaaaacataatggaggaaacattacacaccaccagtttctaccttgtccacttcctataattattctaaaggcctcataatttccttgaggtaaagtgatattaccataagacttatcaggaaaattttccctagacaattcaacttttacatcataatcataattattatccttaattacttgttgtgcaagtgttttaacatcttccatcttatcttttataatttttcttgattcatctaatgattgtgaagaatttaaataaggatatagataatctataactctattcttaacttttaacttcaattgttgatcatcatcattatcactattagcaattacatgaaatcttattaatgaatctttaacctcgtcgtaattgagaaccctcatattattatcatttttattactttctgttgcaattaaactatttaccaaacttgtactattacctctaacaatgcttgtacatccagaaaatatatttatacttaatgttattaaaactaccaatactattttttttaatttcaaatattttatcatgaacaaacccccttgtagctaaaattattaccacttggaggttttttatacattcaatttgaattaaattgttcttgttataaatacatctttatatttttttttcatttcatcataacataactgcgcttttagcatatcatcaaaaagagcaaaaacagttggtccactaccactcatcattgtacctatagatccaatagatttcatttcttccttaatgttagtaataactctatgcttccttaaagtaacattttctaataaatttttcatattatttgctacaaaataaacatcatcattattcatattttctattaaactatctattttaggatgaaatacaacttttgataaatcaaaacatttataaacttcttttgttgatacaccaaaaggtggctttactaaaactattattttatctttaaatgattttaattgggtaattttttctcctataccttcgcacagtgctgttccaccttttatgcaatatggtacatcagctcctagtcttagccctatagatttcaattcttcatcacttgcatttacattaaacatcttattcataagctttaaaactcctgctgcatcggtgcttccgcctgccaatccagctgaaacaggtatattcttagttaactttatatctactccctgactaatagaataagtttccttaaatattttcgccgctttataagctaaatttctttcatctgtaggaacatagtgcttattacaatttaaccttatctcagattcagttttctctatttctattatgtcatataaatctatagtttgcattatcatttttaatatatgatatccgtcttctcttttcccaacaatatctaaggcaatatttattttggcataagccttaatcttcattatcttattcctttcttaacattttgacaatattttatcataggtaaaaaatcttgtctaattaataaattaaaaaaggattaataatgtctattaaacattctactatgcgatcaattttagataactttaaatcttttattaagagttataatgtattactgtactgtttatattcttcatcgaacgcatctagctgtttgtttggttcctcatttataaactccaaaagagaatctaatttttcatagaataccacaattatatcgcccttattacttatatctattgcatattttaacgcttgaacttcatctagacaaatctttaaatttgcatttttattagttttcaatattgacttttctaatatatctgcaatctctccagattttctaccccttttatctttatcttcttttattactattttatcaaaattattagcacatatttctcctattgcgtatcctatatcgtcttttctatctcctggtattccaattaccccaattaaatcattatctcccttaatctttctcaatgaagatataatcgctctataaccttcaatattatgagcataatctaatatgactcttctattaaggtaattgtacatattaaatcttccactattatcttcgttctttaatccaaaatccataaaaccttttgaaatcatacaataatcaacttctaagcctacaagccctgcacaagctgccattgcattttctatattatattctaatgttccattatatgatattggtaactctctagtagatacaatttcatacttcttcttattattaattacgcaaattttatcatcttcaacaaatacagctattttgccattagctatattttcttgtatcaacggattttctttatcttttgcaaaataaattttttctgctgagaatctatttattacagttttgctatatttatcatcagcatttacaacaacaaaaccatcatcttttactgcttctcccactaaagcttttgtaaaactcaactcttcaatagaattaattccatccaagcccagatgatcattggttatatttgtgattattgctacatctgccaactcatatgctagccctcttttaaccaatcctcctctagcagtttctaaaacagctacatctacatctttattcatcagtattgatcttgcgctattaaatccagaatcatctcccttatgtatacacttttcattcaaatatacaccatcagtcgatgtcatgcctacattgcttcccatctttcttagcacatgacttattaaccttgtagtagttgtctttccattagtgcctgtaatagatattacaggtatatttttaggctcttcatcataaagcgtttcaagtattgcttttcccacattacgccttttaccttttgaagggaaatgatgcattcttatacctggtgcggcatttatctctaaaactactccattattatccttaagcggaacactaatatcttttgcacaaatatcaactccacaaatatctaaccctaaagttttagctgcatttatgcaactttctatattttcctcacagatttcatcagtgcaatctattgctattccaccagtagaaagatttgcattctctcttaataatattttttcaccctcttcagggatatagttcagttccaatcctcttttagaaaggcatgatattaactcagcatcaatttttattttggttaatgctttttcatgatcctctcctcttaatggatccttattaagaacatctattaacatccttaaactatcttttccatttccaataacatatggagcaattctcaatgatacagctaccaccttgtaatttacaacacaaactctgtagtcgcttccttcaaagtatttttccaaaattatatccttttgattttttcttaagttaatatatgcatcaactaattgtttttgatcttttatattcagtattactccttgacccttgtttccgcattgtggctttaaaaccactggatatccaattcgttctgcttcttgtaataatccaattaaattaagcactttacttccgtctgctacaggaatattttgagtttgaagcaactgttttgttaagagtttatcgcaagatatatcaactcctacacaactagtcttgtttcctatagaagcctctataattctaccagcttttccatatcctatttgatatatggtgctgtcccctagttgcataacaggaagtttatattcccttgccgcatcacatattgcttttgtagtcgcacccatttgctcattttgcaatatattttgtataattttcattcttccatcgaaatttattggattttgcgcgatcaaagaattcattaaatctatggctaaattagccacctcaagtattgtatttttatattcatattgtacgataatataatacatatcacctttaatttctcttgcctttccataagcaacatctattcctaaattattttgtatcgctatcatagtgtgttcacaaatatgcgctaggtaagttccttcttttagtcttttaacaaaaccaccttcttcatcaattccgcatctatgattttttaattcaggaattatatttacaagattaaaattaaaattcggtatgtccttacttggtatttcagaatatccttccaaatccatatctattcttatacactttttatgagaataaatattttggccttcatatattctcttttgtattatcttcatgattaaacttttcctcctcaaaaggtgacttttttataagatcaaatttatttccatcagttaatacatgcaacttaacattatgcatactcaaaatatcatctgcatataattctgaaacattagtatatgtaattgcactaccatcaataaagtaaactgctccttcacctattacctctatcattccagattggtttactactattcctgtattctcatctattcctattcctaaaacctcagggttttgtgcaattcctgttaataatctccctattcttcctctttgagcaaaatgttggtcaattataacatccttaatcaacccaagacctggagacatttttaatgtgcattttctaggatcatcatcatcttccccttgaactatcattgtgtcactcattacggatgctcctgctgaagtacctactataaatgcaccattcttccaagcttcttctaatgcatcataaaccggagttccgccaattaaacttgttatttttaattgatctccaccggtaaaaaatattaatgaagaatctctgattagctctacattcatatcatcagatgcttctgttctctcacttatatctaatacctttatattttttacttcaagttctccaaatacctctttatatttatttgcggcctctttaggataatcagttgcaatagttgcaattaataaagtatctttacttttgtcaattgaatcacatactctttttaaaatttcttttttgccttctttatcttcggctcctccaatgattattaaattaccacttaaaacttttttcaaattttctcacctcatatcatgcattacatattctatccaccagattaaataattattcaagaaatttggctgctgcaaatgccaaaccacgtttcctataagaataatttctctagtttttacttccttaagttcgaagtaattagcaactataaaacaaaacttagtttgtgtatttttcattttattatgtaaatattttttcttcatatccaaaaactttttctatttttagagcttaataatattgcttcataaaaaaagagatactccagaattcatctaatgaaattcttaaagtatctctttttttataaatttaattaattttagaatattgcccttcctggtattatcaatttttgtccttcttcaatatgttctggatcttcaatcttatttattttaattaaatcgtcaactgttgtattatatttttttgctaagttccagaaagtatcccctttaccaattacatatatagtaatactagctttcttttctggaatatcgccctcttcttcaaccacatctgaaacaaattctttattcatttcatacaatactctgccagatagtatcacagtagctttaatcgctatattatttccttctatagccgcttcaatattttctaaattacttttaattatagatttcatattttcatctgcgcctgctatatcaattgcagctgagaatggtatctctgctttaacacttgataggtatttctcctcatcagttgtcttatacaatatacttgcttttataattccctctacaataactctgtcttttacaacttgtttatctgttaatattatagccccattagcagatattatatgttcaggtctcaaatcattatctttcaattgaatattatacttaacaattgcttcagaattattcattccatgaagaattccaacttcatgttcatcttttttgagactaagcaaacaattggtagaatatgcatctttaatagtatctatgttttcttttgaaaatatcttaacatttgctctaactacaagctcatcgtttataattcttatttcgcctaaatcatcttcttccaacattaaatcattatttgatatttcataggaaacagttggaatcatatctgatgttataccattaatttcttcctcttttgataaataaatatcatcttctaatggaattatttccttagaatcttctcctttgtatagtatatttaatttgcagtaacagccaagataaactttatcttctgttatttttatttcctttttatgaagtagtaaggaacactttaatattttgctgatttgtggtttatccataccaactctaatcatagatttgcctactaattcaacatcctctgttgcattgattttattaattgtctctgtttttttcaatacttctacttgatcattgccctcaatatcttttacaaattcaaattcattgctcttgtaaagttcccaatctacagtaactataccctgaatagatattttcctctcattcattatgtttgcttcaatatgttcaatattacactctgcctcgcaaattactctattttccccttgatttaagtcaatattatttgtaaagttctgattataattcaccgaatttactgcgagtccctcttctttagctaaatatattactgtgtactcaacctttccttctataactactttatctccaattatttctttattagttaccattggtctagcttcaacagttaatatctcttgtacatcaggatgggtatcagggattaagtattcatcttttaataccgaattcgtattattttccctaagcaattgttcaaactgtacattttcttttacaatatctatatctgccatattttatacctccataaaattcctactattcatttatatacatatgagtagaaatttatgataaatatatttttattttattctaacaaattaagtaaaccttttacttaattcacttaacaatatttttttaaatttttttgcgttttttattgacatatactattttttgtcgtaatatagtaattggttattgaccatataacctctcataaattctcaatacccttttataccatagttgaaagatggaaacccaccatctttctttttttataaaattatttagttaatctaaatcctattatcatttttaatcataaaattatattctatttatggctttctacgtataaaaacacttctcacaatttctaattcattaattattttaaataaatatgaatattaaaaactcacttaaaaataaaacaaaaagaaaaaactccgaattaatcgaagcttatattctagttggaaataccaattgtacagtctttgttaatacatctgaataactataagtcacggtcctttgggtgtcattttttaatcttataacaaaaatacttgggtatacactttcaattataccatcattaactaaaatctttttccttccaccattagcttttagagtcactttctgaccgacgtgtctctctatatcgtttttaatggaagcaatagttttaactttttccatgtaaacaccctctttcatactaattatataacaaaatcataaattagtcaagtaaaataaatattttatcatttatagcaccatattgtcaatgtaaacatttttccaattatatatgttttcaagctattttattatattatctgctttttcttaattattattccccttatcattaaatttaattctataacatttcataatctataaataaccttaattttatttttaaattgattccatgttcatacttagataagtatataatttaaaatcagatattatattaaaaatctttcttagctcaatgttatatctataaactattcccccttcaattattctatactcttatcctattaacataatttcgagtatttccaatgttaaatattgaccaatactacttacggtaatattggtcaatattttattccttactatattttttaagaaaatcttagtagacattttatataaagctggaattccctctccgttcagaatttattctcaacaataccaaatgacattttttaatcatataaaaatattttttactataaaatactcctttaatcacacgtacattaaagaagtatttatatttattctctatttttcattaattaatttttcaatttgatcagcaattttctctggttcatatgttggtgcaaatctagctattacttttccctcttttgatacaaggaattttgtaaaattccacttaatatcatctccacttgtattaaagcctttttctgataaaagattatacaatccctttgatgcatcatcttcgcttgcaataggagcctctttctttaaaaaaacatataatggatcactattctctccatttacatcaatctttgcaaatgttttaaaggttgttccgtatgttaatttacaaaaatttgatatctcttcattagtccccggcgcttgctcaaagaattgatttgatggaaaatctaatatttcaaatccactgtctttatatttatcataaagcttttgaagcccttcgtattgtggagtaaacccacatcctgtagctgtattaacaattagtaatacctttcccttgtatgtctccatagaaaccgaatttccatttatatcttttactaaataatcatatatcattttgcttctctccttatcatctttaatatgaaattaagtgaataaacttatatcttcataaattatattttataaaattaaatttgttaaaatcattatatattctattattatttttgtcaaatagaaatactatatttattaattatagttaaaaacttcaatactcttactaattactttgatgcattgaagtttttaataatttattttatgcaattcctatctaaattatttattaaatataaggagatttaggatatccttctctatactttccccttgtctgcaatcctccaactccctttattcctgttatcgtattttcaataacatcagttattgatactaccttatcaattcttgtataagcaatcttctcacatacaaaaacagggtccaggcagtgtattaatactcgatttggactcgaggcaaagttagcacctacgtctaatattctttcatagcaactttgacaagcccctgcaaatattactaattcatcataacttgaattataatttcttaagtttttgactgattctaaatagtatcttgaatttctataattatctaaattcaaataatcccttggttctcgtaaaacactatcgtgtccagttaaaactactatgtccggttttatttctttaactaagtctactattacctctggttgatctttttccgctatagctctccccactgcatctaaagataattgcttatatacctttaaacaagtctccatgtactcactatccccatctacatggagaatctttcctggccttccaaacatcaattcattcttcgtctttatcttaggagatttttcaactttatccctaagatcacctcgtagtatcatagctttctttatggcctcattaactcttgtatttaatattttatcttgagatccagtgtcctcttctgccatttcaagatcatccaaacttgcatctgctattattcttatattaattccttttagaattatattatactttccgccactatctttaatatcaattattttaaaagtaatatctttattataagattttctaacaactatatctcctatttccattactttctcctaatacattctttcacattataatatggtaaagattattaaaggtttctaaattaatataagaatgattttattctatctaggcaataacaaaataaatgaactatcgaaataattttttaattatttcggtagttcatattattatgtttattatatcttatattcattcttgaatttttctaaaaattctaggtatttctcttgctcatgtattattgattctaacttacctgcaaatgtattttgcccccaattaacttcattataataatatctatttgcaagcctccaatatctttgtgggaattgaagatatgcatataataccttatattcctctggttttaattttgatactgaatcataggattctataatagctgtcgcaaattctaaattccactcaactctctttagcacctttatcataaaattgcttatatcaaaagttctaacttctcttttacagtaatcaaaatctataacatgtacatccatactatcgcttaaaattatattatgataagtaaaatcatgatggcaaaaacttttttcattctcggcaattgcacataactcatagtaatctgactcatttaaagttactaaggatttctttccgatctctttataaaactccatagattttaaataaagcatgtcaaaatcactttttatactttttttccttaccatatctctcattttatctaaagatttaattcttttttctattaaatgaggccatctgccaagatcacttttgagcttagaattctcaggtggatcatatcccttagatgcttcatggagattagctaaagtctttgctgctatttttacttcatctatgttatggaagtcacattcccttccttctaaccattcagacaaagtatataagtcttcattaaccaatgcataaggctctccatttatgtttaaatagtatttatctaaattattaaaaccattttttcttaagtgctctttagcaccatacacgaacaacaacttttggggtccataatttatttttttcaaacatctctcgcctttatctgttttaagatagtatacgcctttatttgccttaattttttctatctttatattgaattgtctttcaatttcaaattccctcatcatacttctcacctcctgtatatttatatgaggatatcatttcttttattaacattttttatattcttttaatataatacattaagacaaatgctatgaaagggtttaataatgaaaataggaatagatggtagagctgcaaagtggtatcgaggcacgggtataggtacctatacttatcagttaatatctagcctcaacaatgttgatagtaacaataactatttaattttcacaccacaatgtgactttataagcgatttaaagaataattttaaaacagaacttattgaatcaataccttctaatagtttttgggatgatataaatgttcccaatatattaaataatgcagacatagagctttaccatgtcccacaaaacggggttggtctatcagaaaatgttgaatgcaaaaaagttattactctacatgatataattcctttaagaatgcctgaaactgttagtgatagatatttaaaaatatttaataatgaactgcctaaaattttagataattgtgatggaataattactgtatctaattactctaaggatgatattgctaaggaatttaactttcctgctgaaaagatttatgttacccaattagctgctgaagatatttacagacctatgagtaaatgtagatctaaagactttattaccgagaaatatgggataaaggaagacttcgtactttacgttggaggatttagtccaagaaagaatattataggactaatagaagcttattctaaactcccaaataaattaaaagaaagtttcaaactagttataattggtcgtaagggtccttcttatactaaatacaaaaatagagctgatgatttaaatatatctaataacgttatttttactgattttattcccattgaagatatgccgttgttttacaacgctgctgaggtccttgtatacccttctttttatgaaggatttggacttcctcctatagaggctatggcatgtggcactcctgtaatagcttctaatgttacgtcattgcctgaggtatgtcatgaatcagcactttttatagatcctaatgatattgattcactatcttatgacatagaaagagttttaagtaatagcttattaaggttaacaatggtcaaaaaaagcctaacgcgaagtaaaaacttttcttggaataaaacagctctagatacaatatccgcctatgaagctataataaattcatagaataatacactaactatataaaataaaatttatattttttatataactagtaaaattccttcatagtttttgtaattagctaccttataagtaatttatattacaacagtttcaattaaacaatttctattaaatatctgtataaaggcaagaaaatcataagagattttcttgcctttataaattctcaatattttttaactaataagaaaccaatattctatttacgaaataaaatattggctcaattattataaatagatcaattataaattagatttatattattctttgcattcaaataaattaaacttatatttaaattacttctttacttcagcacctatgaaaaatttattttctaaaacctttaaaaattcatatctaaagtcctcattgctcaactttccttcaaatctgcttaaatatacttcatattcccagttctttctcttatgataataatctcttgatattgtataaaaatctttagggaactttataagtatatacaagagttctttttcttctttttttaaaatggacacattctcatatccattaatacaagttgacatcttatccacatcgaatgcggcattctttatacactttaaaataaaattccatatatccattactcttaaatctatagtcataaaatcaaaatctattatatttatttcattatttttggttaagaaattatgataagctaaatcattatgacacaaacgaatagtatctccatcctgtcttaggttatcatatgagcttttttcaaggtcattttgaacctctttaatttcatttaaatacttatctacattatttacaaataatttatcaaattcatttttatatttatacgtatctactaagctcttcatccaaattaaatcatcatatgcttctttaattttatctttcaaagatatatctaaaaaatcttttttgtatttatccttcaaatattctcttaatccttttgaagctttatgcattaaagctatattttctgcacaaagatcaatttctactggattagaaaatgatgcttctcttccattcaatatatccataacaatataaatttgtccattccattctttataacataaatcatctttgaaccttttatatgttattacatgttcataactcttttttacatagtctaaagaatcacttattaaattgactctatctacatcataatttactcttttcaatattttatttccttcatctgtatataccaaaaatacttttctaagtggaacaatgtcgtttacttttattcccagttcttcgaagaactttaggctcaaatcataatcgcataaataatttttttctgaatacttagttctattcatattcttcctcctaacaactaagctttaggtataaacaataactacctttggttacctatatgataaaatttttactttcatactttaaacttttcttcaatccatttaataattgttcgtcattccttgctttcctactacccttacattcctcattttgtatattataaatttctcttgtattatcctttctactatctctatacctctcccaaaactttaaaaaatcctttggataactgcaaagccctcttaaataatcaaagctgttaaatgataggtgtgatccatgtacaaataactttattagttcttcctcatctatattaatttcctttctttgtagtttcttaatataattatataagtcttcttctaccaagttatatgtcataccttttattgtacacacttctattttttcattattttttcttaaattacttttatcaactttaccaaggcagatttcttctctattcatactacgtcttataactccaaagtagtcatgttcataaatataatttatagccttattagctttttccaacattatttttccgtttgataatatgatattctctatctcatttgtacatgttttactagatacatatgaataattcttttgtagttttcttatctgcactttataagattccacttctctgcctattgtgcttttaattttgcttagccctgttagattaccccctaatagcaatttatgaaattctataattaaatcaacttgagaaactatatcatttctttgcatatttttatcataactaaaaccttgtcccataatagctattccttttttatttaaatactgattaatcaataattcatccatattaatttcccccactaaaataactatcaataaacttttctctaaattcacaatcatttaagtacttctctaacttattgatgaaaaattcttctccccatggttgctgttcccaataaacctgcaaccctatttgccagaaagcctgaggaaatcttataaattctctaattataggtagctcttcttttcttatttctattctctcactataggcatttaaaattagattacatttgtcgctttcccattttccatctttcattgatcttattaataaagaagatacgtcgtggagatgtgaatctaatatgcagtaatcaaaatctataatattaatatttttcttattatctattaatatattatgatgagcatagtcatggtggcaaaatccccttgaaagaacttccttttccataacctttacataattatttttttgaagacctactatactcttttctgctctatttaattctttttccatattgtccaaatacaataaatcaaaatttgatttatatgctttttgacttattctatttttaaaatccagtatttctcttctccttgtttcaaaaacatctatccatgaaaaccatccaatccttggtttcatctctttcttcaatgtaaatcctttgctgcattcatgtaattttgcaagctcatttgataccattgataattctattggattatcataattacttactctcgatggaatccattttgttaagtacgcatactttccgtttatgttcccatattcttttttttctctattcataataaattcaggaatatccccaaatccatttctttgtaaatgcttcattgcagataagataaaataaaaatgagagaattcatatttaactactttcaaacaatatctctcatcccttgtaataactttataactatttttaactttttcaatatcttctacatttaaattataattttcttcaatatagcctttaattttaagtatctccttattattctccataaactttttcctaccagctattatttatttttattatatgtgctcaaataatttattgtgatttatattcacaaaaattaaaaactaataatattctgtattatatatgtaatttgttgaggtgttcatatgaaaattgccattgatgctcgtagttccactttacatcaaggaactggaattggtacttatactagtaatcttatatcagagattctttctttagattcgaatgatgaattcactctattttgctctggaaaatttaacaaagaattcaataaggaaaatgttaatataatttattcttcaggtagacatggcggtttttatgaaaaatattatatacctaatgcacttaacaaggtccatgctgacctataccatattcctcaaaacggaataggactcgattttgatacaaaaataccaactatagttacaatccatgatctaatcccatatataatgcctgaaactgttggcaaaggatacctagaacgatttttaaataatatgccaaatataatttctaattcacgcggcattctaacagtttctgaatactctaaaagagatatattgaaattctttagtttttatcctgaagaaaaaatatttgtaactccacttgccgctaataataattttaaacctttggataagaatcaatgtaagctatacgtaaaaaacacatttaaagttgatgatccttatatattatatataggtgggtttagtttaaggaaaaatgccttaggattaattaaatcattttgtaaagtttataaagacttgaataagccttataagttattgcttgggggccctttaaaagatgaaggtgaaaagttactttcatttgttcaagaaaataacttacaagacaaagttgttttttgtggatatatagaagatgatattcttcctgttctttatagcgggtgtgatgcatttgtatacccttccttctatgaaggctttggccttcctccgcttgaagcaatgagctgtaaggcaccagttataacatcttctataacttctattccagaagtaactggtgatagtgctattttgataaatccttataatatagaagaattagacaatgccttagttgatcttttgaataatgaaactttaaaagctgagcttagtgaaaagggatatctaagaagccttaactttacttggaataagactgccaagaataccttaaatgcctatagaagtttaatatcttagacttttataattatttaaatctttaataataaattaaatgtgaattcagagtgatatttcaaatactatattaaaataaattcagcattataagaaacaccttactgttttccttataatgctgataatctaaaactatttatataaattttcattattaattggtatttgctcgaatctcttgctttatctttatatattcatcataattacttatgattggagttttttcttctatattacttaatactacaagaggactttttccagtaaaattttttactggctcctcaatatctttagtattataagtatataaatagcttgagaaaaactttccttccttaacatatttaacagcttccttgttgttagttattacgtaagttataaatttttcaattagcttatcattctcgctgttttgatttaatattaataaattatctccttccgatgaaaaaaacttattagcccctggtttaaggctaggcacgttattaacgctccacgtacaaggaacatctaatgctgctatttctttcattgcattaatagacgatattcttgctaagaattctcctccactttgtaagtttaaaatattattatcctctaattttttcatcatagcttgaacttctgatttaactgcatctatgctcttatcaccatcacttaatgtttccatggttaatagatccatcaaatcttcgtaatcttgatcagtcgcattaattataaatatttttccgttgcttttttcatgaatatcttttccaatccttatgatatcatcccatgtattcaaactatctcgttcatatccataactttttaataaatcttctctgacatagaaagctaatggcctagatgttaaaggtattcctatggaattatcaccatatttaacctgagctaccctatacttagaaaaattcttagcatattcgctcaagagcttatcatccttgttataatattcatagttatctaattttagtttatcaaaactaaacctatctatctgcgctatactagaaatctttgatttcgtacttccatctgaattattattaattatatgattgtaattttctaacttctttacacttattgaagtcctatcattctccttcataaaattatttgcgcactcaactaagtactcataggaattctcatttactaagagctctatatttcctctaacttgttgctctttatttggttgaaatagattaatgcttactattcctattagcaaaagaattgaaaatacaatagcatatttaattttatttttcatatttatatacctctatttaatagaacttattttttcatgcacttctattaattcaactgctaaatccttcaaaaccattgtagtcattaagtgatcttgagcatgaactaaaagcaaagagaattctattttctcatttacagcttctccctgaattaaacttgtctgagaattatgtgcatatcctaattcctcatcagcttttattattaacccttttgctttatcaaaatttccttgcttagctaaagtaattgcttccatagaaaaagttcgtgcttccccgctgtgcattattatatttaatattatttcctccatatatttatccccttctccattagatatcaaaaaactatcaaattaagataccttacccttataatctttaattttactacttttccttaaagttttaaagaatattattttaatgcaataaaaactagaattgataatattatatttatcaattctagttttaataatcaaatatatttaatttttatatagaaggattttaattagatttttcttctaatacaactgacaagtcaacagttttcttatctctaattacttctatcttcatggtatccccagcattcttactttcctttattgccttaagttcatcgaatttcttagcttcttttccgtcacatttaacaattatatctccaatcttaagaccacctttttcagctggtgaatactcttcaacagaagatacatatataccttctaccaaatcgtatttcttagcagtagcgctatcaatttctcttatttgaattcctagatttaatataggttttgataaagcatctatcttattcttaacttcatttataggtattgcaaaccctataccttcaactggtgttgatgatcccgatgcatcagaacctatcttcatagaatttattcctataacttgccctttagcattaactaatggacctccactatttccagggttaatagctgcatctgtttgaatgaaatctacacttttcccactatcatctattgttctattgcttccacttataactccctttgtaagtgtctgagcaaagttctttgaaagaggtgttccaattgctataacctcagctcctggatatacttcatcagaatctccaagttctgcaacagcaggaactttagttccgtcttttaatttaagcattgcaacatctctatcttgatcgtaatttactactgttgcacttacttcagtattattacttaaagttactgtaatttctttagcatttgcaattacgtgatagttagttagtatatatccttcttcatttataatgaatcctgatcccatcccctcaacttcgccgttcatgaatccattgttagatgaacctttcgttgaaacaataacaactgctggcgcaactttattaaatgcatctgccgctgacatcgcatcaggagtactcgatgtgaatgattgtggaatataacttgttatttgtttagttgcagcaacattattagttttcatgaatgaataagtagcagcacttccaattgcccctcctaccattgtaagaactaaaattcctgcaatccttcctagcatgcgtagacctcttcttttctttctcttcggatctgcataattattactattttgaaaacaattttcccatgcaacttgctgacctttatctactggtaatgactctacatcaataaatttttcattattatcattattattcatgtatttttcctcctatatatcaattctcaacttatatgactagtaattaaactatacaaattggttcttataaagtatattagaatactttaaatgtctactagtattatctttatagtgttagtatagatttattatgtgtcaaacaaatgacaagaatatataatttgatataattttttatgaattttagcccaatagaagctttatttcttaattattcaataatacttaatatttaagaaaatatacatatttattagaatcaagattttttagctgccttcttagcatcttttaaaacactattcacaccggtaaccactgagttaggatctaatacagacattggagatccctttatttcctctttatatatagttgttactgttgtattaccaatctttttaacaggatcagcttcattattagttattaaatataatggcttatttcctagtagttcattggtttgactgttcgaaatgcctttatataagttttctagttcgtttgaaactgcctgtttataatttttcttattttcaaaactctgaaattcatctaattcattctgatttaaatacttcttaaacgtatcattttccatagttagccctgctttatttaacaatgcagtcaaactaaaatttgtaccgattttctcaaacatacttctataatatttggatttaatactatccttaaattccttagtttgaatattttcctctgatattgggttaattaacacaactcctgctactgaatctgaatataaattggcaaaattactaagaaccagactaccgtactcctctccaactaaaacgtatggctctggtgctccagcttttctaagcaatgctttcaaatccttagcctgctcttctggtgttctattatccccgccatcattaaatccatatccttccctattatatgtaaaggtagatatcttcttctcctctaatgacttacaaacatcatcccactcatacattgtagttccaattgatccatcaaatactacagtataatctccaccagtcttaagtttatactccattttacgtccatctattctgacatacttaaatctagattttaatcttgtattatctacaaagtcatttaaaatttgcactaaaaaaccaaagataaataatcccacaaaaaagataacacatttttttaaaatgctccttttgctggttttatctttctcaaccttatgtactccattagaatgtgataacagcttcatacctagactctacctctcccctagttttaagttaggttttgcatttatatttaaatctgatactgctccctcttgatagttgaaatatgctgcacttcctatcattgctgcattatctgtacacaatataggtgatggaaatagaatttcaattcctttttttctaccttcctctagcaaagtttctcttaaacaagaattcgatgcaacaccacctgccactgcaatcttttttattccctttctctcacaagttaagaataaattggtctttaatacatctattatcgccttttgaaatgacgctgcaatatcagctttatttacctcttcttctttcatttttgctttatttaaataattcaatacagctgatttaactccactaaaagagaaatctaatgtatcatcctgaaacttagctcttggaaattctattgcatccttatttccttgcttcgctagcttatctattttgggtccgcccggatatccaagttccaatgctcttgccaccttatcataagcttctcctgccgcatcatctcttgtttggccaataacctcaaaatccctatatccttttacatgcacaataaaagtatgtcctcctgaaaccactagtgatacaaaaggtggttttagatctttatgctcaataaaattagcactaatatgtccttgtatatgattaaccccgattaaaggctttttagaacctaatgctaatccttttgcgtattgaagcccaaccaaaagtgccccaacaagtcctggtccatacgtaactcctattgcgtcaacatcgtctattgaaattcctgcttctaataatgcggcttttacaacactatctactgcctcaatatgcattctcgatgcaacttctggaaccactcctccaaattttttatgagtatcaatttgtgatgcaattatatttgacaaaacttctctaccattcacaactactgctgcagcagtttcatcacaacttgattctattgctaaaattatttttttatccatatctaatacctctttttattacaattcaaataaaattatttattctgatctatctaaataggctgattaatcctatttataacttaattttaactaatctaacaagagaaaactttgatatattagttaaaattaagaactatataaattaaatactttactataacattatttaatttatctaaatctattttatcttaaaaaaaagataaaatctcgtatttatatattgtttaatatcttcttaatatttatgaaatcatatcttttcaatgcgcaaactattctatattttaattactaaaatattatactttatctatacaatattatcaaagttcaatttttctagttatgcagatgaacttaacatatatcttattctcacaatttcattgcaatattaacttgttgtataaagggtacatatgatgtatatttgagataacaaatatactttcacgaggagaatttaaatgtctaactatgctaaagttataattaaaggatcacctattacaaaatctaattttaagttacacaatctaaatggacgtgcaatcctaccacatagctctggaaaatatcatgataggtatgctctatacgaacaggaaatagcacttcttgcaagaaatcaaaatcctgatattgttttttctgaaagtctaatagctttactaagagtatattataaaagtgaaaagcgtcatccagataccattaatattacaaaaagcatatttgatggcattgaaaaaagtggattaattataaatgatgctcagataacaaaaatctttacagaagaatattatgataaagaaaatccaagatttgaactagaactctttgctgaaagtgaatatgattttagctataaagttgtcaaaagaactacttccttaaaacctaaattatattctccaataagaaaaaatatactatctgataaaactagtagttctgcaactaattatcaaaaagataaacttgattgcaatgctgaaaataaacgtgataaaaaatcaaaaaaaacctcatctaactcattaatgtctagcgaaatgattatatgtagcatctgcaataaagccattatttcagatgattatgtaaaagccgattcaggaaaaacattaatatgtaaaaagtgctttaacaaactattctaattacataaaaggagtctatatatgaataataagcttgatatcattttctttggagacagcctaactttaggatatggggtaactaaacaaaattcttgggtttacaaacttacgcaagaacgctccctttcatcattaaataaagcctgtaatggtgatactaccacttcaatgcttactcgctataatgatgatgttttaatttattctccatcgaaaatttttataatgggaggtagcaatgatcttcttctaggacgcaaaattccttttataattagtaatattgaaataatgattaatgatggactaaatataggctcaaaagtgactttaggaattccccctaagattattggccaaatggcaaattcgcttttttctccctcgcatctatattcttatgcagaaaaagaacttcaatatttaaaggatgaactcattaaattatctaataaatacactcttcaatttatcaatttctacgatttgacatttaatagggatgatatttatttagatggaattcacatgaattcacttggccatcacctaatgtatgaaaatgctctcaattatttttaaaccatattattctgtgaactgattagcagtaattttagcttttattatattactgctaatatatctctacctaacttctacatgctttcctttacaaatctagccgcaataattccacattgtataccatcagtttcttccatccaaaacgcattttctccgtatataacatttccacaagcaaaaaaaccctctaaagatgtcgcaaagtctactacttcaaatccagatgtcttagaatttatatcaaaacttgtttttttaattacggttgtttctggcaagaaattaactgataatagaagtgaatcacattccttttctattatttcttcattctctaaattaactatttttagcttctcaattcgcgttttcccttcaatttctgttactctagaattctctattactggtatatcaaagccatcaataatatctcgtatttccgaattaaccatttcctcaaatgtattctcaatgacaaccgcttctatatttccaccctctactataagccttcttgcaactatgaatccccatttatttttcgctataatcacagtccttcttcctggtagatatccatctaaattaattattttatgagcctctcctacagtgaatattcctgtaagtccattggtaggaattataacatttcctgaatatgtttcttttgctcccatagcaaatattatcgcttgagcggttaaatctttaataccatctctagaatttacatatgtaactttttttccttcagttacttctaaaactgtagtatctaaaagtatttctatttcaaattctcctaactgcctttctataaaatcaatatactctgggccggtcactggctcatctagaaagttttttccaaaaccattatgaacacattgattgattattcccccaacgttagactccttttcaataattagtatttttgttattccctctcttgcagctccaagtgcagctgtcattcccgctattcctgccccaataataattaattcataatctggcattataatatcctccaccattaattcctaaagctttattaatttctttgctttcttcattgcaactaccatatcatacatgcttgctatttctccaaaagttatttgttctgttaatttataataatccaaggatgtatcacttattaaaagtttaacgccctttttatatagcattcgtatatcttctatagccttagaatcccttttaaacaacttaacccctgaatttaagaataaaatttcttttggaagtttatcatactcatttaatgcttcgaaatattcactcattaaagttattcctaaatcatcatttccctcaccaattttatctcttgttattaatatagaaaaaatttcttcctcatcttctgattctaagcatcctctcttttccatctttattaaaaatctacttttttcatcctccatatctactttatatcctttatgtgctgcataccttataacattggaccgccctaattcattatttactactacaacagcttctccttctccaattgaattaaaatacttcttaacttctcttattatttgtagatacgataatcctctgcaatctatttctttcatatgtttgacccctttataattattttaatatataattaatatatcaaatttttcaatcgatttcttaactaatatataacttaatttaaaaatatattaaattaagttattataagtctattatataagttttcccacattaatagtataccatgctaatttttatatatagttttttattcacaaattatttaccttttaattactaatatatcattaatttatatttgtttaatccataaatttatgtatactataatgtagtgatatattgaattgaggtgaaatcatgagttcttctaactcatatgttgttaatttttttaaaaatagcttagaaaataatataaaaaaagataaggttataagattaattttctttctaatagctcttgtctctatagtattaaaagggattatatttcaaggatttgttacgagcaaagatccatatacatttagtttttctactggctatgaatctgctagttctttcttaaattattatgtggcctttactttaatattcttaagtttctcattattatttaaaggtaaaggcagaataatctatactctagtaatcgatttttctttaacactattaatattagttgatgtctggtattttagaggttttttaactgttccatctgcattaatattaactcaaactgctaatttagataatatgtctggaagtatattatcaatgaccagcaatttagattttatatttgtatttgattttataatactaggtatatatgcttacataaccagaaaatcatttactcaagtacataaacgagcatttaaaacattcttttgtacttttgtattaccaatattatttataatttatgtacctatcagtataactgtattcaataatacagatgttcataatgcttacttattcagtaattatgataagtcaaatactgccaaatatttttctcctattggatatcatattatggactgttatacagtttataaagattctaaaccatataaattaacagatcaagataaagcggatataaatgagttatttgaaataaaaaaagagaaccttccagataacgaataccttggcatggcaaaaggaaaaaatttaatttatattcaagttgagtctttagaaaactttgttatcggaaaaacagttaatggaaaagaaataacacctaatttgaataaattagtacaaaaatcattgtacttccctaatacatttgagcaagtaaatgaaggtacaagctctgatgctgatttaatggttaatacttcaatgttgcctttaagacaaggaagtacattctttagatatccaaatactaattataattcgttaccaaatttattagaaggtgaaggctatgctacttctgctattcatcctgacaaaggttccttttggaattataaaaatggattgcttggaataggttttgataaatttactgactactactcatttaatgttgatgaacaaattggccttggtataagtgacaaaagatacttcgagcaagttgttcctatgttaaaagaattaaagcaaccattctacgctgaaactgtaacattgacaagccatggtccatttgatcttcctgaaaagtacagagaacttggacttgatcctgaattaaatgaaagtaaacttggtgggtattttgaaagtcttcactatacagataaacaaataggttattttattgatcaattagataaagaaggattacttaaaaatagcattatagcaataatgggtgaccatacaggaattcataaatattatgatgatagcattggacagctatctcataaagaagattggtatctaaatacaggaaatccgactgttccatttattatctataatccatctacaaatgaaggaaaaacatttgataaaatgtacaatggcgagattgatgtaatgccaacactcttatatttacttggagtcgataaagataagtacgagaacactattttaggtagaaacttattaaatacaaataaatcttttgccgtaataactaatggaacacttaaaggcggggaaaacttaacagataaagaaaaagatatttataaaaaatcattagatctttcggataaaatgatacgtgcaaattatgctcataattctaattagataatgatattttaactatagtaaagagatggtcaaataaaatttgaccatctcttttattttttcttaatcttttttatctcttcttttaatctatctagtgaatgttgatacttcaaagactttatatttggaaatgctttaattattcgtttattcacggccttattgtttaaaaccaaattttctaatttaaattttagcttgctaatttgttcttttgcatgaataactttttcactttcctgttctatcaagccatcaaatctgcttaaattttgttgtagaaccactttatagctttcagttttttctcttatctcatcaaataaagcgctcatttctttgagttttccacctaatttcaaaactttaactgttgtagttatcccatctgttaataaatataagagtgaaatatcacaaatccacatagaaacctttagtgatatgtgactaactaagtctattataattggattaataacttttattgtgattagagataaaagaccaaataacactgaatttaatagacatactctgccctttatattaaatttatagcctgaataatcccaccatttaagattaaatattgtttctagcaaaaaacctgttaaatactctaatatgcttgtaaaaatcattgcactcaagaataaaattacaatattatctgaaaatggagctagcaatataattactataagtgcacctgatccatagatagggcaaaatggtccttttaaaaaacctctatttacatactccctatcaattatagagcaatatatagtttcacatatccatccgagaaagctataaattataaaagaaaaaagatacatatagattatattcataactatttaacctaccttagcatatctattaaattaataacaaaattattttccagctattgaaagttctttcacaacaactgacggacatcctatgctactcatcgggaactttaagtcacttcctacttcctctatatctttcagtaatgtaaagaaatttcctgcaactgtaatttgttctaccggaaagctcttctttccattttcaatcataaatcctttagctgctaaagaaaaatctccagttacagcactagctccagagtgaaggcctgcaaaatctgtaattatcacaccttctttaacttcattgcaaagttcttcaaaagatttatcacctggatttatataaaaatttgtagcactaacacctactattgatgcatacgaagctttgaatccatttcctgtggatttaattcctgccttatgcgcagtttttagattatataataatgtattcaattttcctttagatattatctcttttttgatagttgctactccttcatcatcaaatgaagttgttccaagcccatcctttaagtgaggatcatcaattatagacactacatctgatgctataatttcaccttcttttcctttcagcaaagataaccccttttgtacttgctctgcattaaaaattcctgaaaaagttccaagcagtgataccatggcctcgttatttataattatcttatatttacctgatggaatgctttttccaccaattcttgaaagcgcttcttcaagaccttgcttagctaaactttttggatctatatcatctatctttttagccataacatatcctgttccatcatacttttcattattatcttgtattattggaactacatatgcacttagattatttctttcatttttcaaattaagtccctttgaatttattattccataagtagctttaccatatccaattccacaaccttggaaacttacaactttatcacattgttttttacattccttctccatttctaaagaaagagctataagctcatcaggcttaatattatccaaatcttttttgtaacagtctaattctttatattccttatccccttcatatataaactgttcatcatcattttctatagcaaatgccgcttcctttgcatttcttataagagtttttattgcttcttcgtctaatatttcagtatatgaatatcccattttgttattgatttttcctctgaacgaaagaccaaaggcattatttagtttatatttttcaacttcaccttcataaatacttaaacttaaactttcagcatcagaataatatatttcaaactcttcaaagcctgaattcttagcttctttaaataattcttctttaaataattcaaaatccatatttatctacctccaacagtcattttctttactctaatcataggctgacctacgttggtaggaatacttcctgatgatgagccacacatcccttgagctacatctaaattatttccgaccatatctatatccataagtacttcactacctttaccaataagacttgctcctcttactggctcctgaatcacaccatttttaactaagtacccttcttgaactgcaaaattaaactcaccagttacagggttaaccgatccgcctcctagcttctttgcatataatccttcttctatagatttaatgatatcatccggattatcatttccagctgctatataggtattagtcattcttgaagttggttggaacttgtaactttgccttcttgaacttcctgtagcctccatattcatacgtcttccatttaacttatcaatcatataaccttttaaaacaccattttcaattaaaatgtttttttgtgtcttattaccctcatcatctatatttagtgatccccaagcattaggtacagttccatcatctatagctgttacctttgttgatgcaattttctcacctaatttattagcaaaaactgaatttcctttagctacagcactggcttctaaagaatgtccacaagcttcatggaatataacacccccaaaaccattatctatagcaacagtcatatttcctgctggacagttctttgcataaagcatagtatgagctattctcgctgcttcctttccgtgatattctggatcaacactatcaaacatttcaattcccatatgtcttccaggtccttcaaatccagtttggttttcgcttccttttgatgctattgcacttatgcctaaccttgttcttattcttgtatcttgaacatataaaccttcagtgtttgcgattaaaatattttgctctttatctgcataacttgtaataacttgagaaatatcactgttataattctttgctgcattatacgcactttttaaaattgctatttttctatcgtatgcaacatccttaggataatacaatattggatgtattgtagatatactcttctcagttaatactattgaatttatttcatttttatttacatcacctaaagctaaagctgctctataggcagtgtctaaaagaccacttaagctattattatttgtataagcatatacactgttcaatcccttgaatattcttattcctataccataacttcttccacctatggcatcatctactttgccgtcaatcaatgctatagaattattaattgaattttcttcaaatatctcagcaaaatcgccaccagttactaagcactttgctaatacctctgctacaatattttttgataacatcttattcctccttatttctaatataaagataattttcagtaatattataattatatacattctattattaagattattgttataaattataaccttagtgcttccatgtatgcaaatctaattatatattaatagtttatcattaattatttctatttcaattaattgataaaaataatatttgtaccaattatataaaaaaactatgtcattttcatctataaattatgtaaccaaagtgtagctacataatttaagataaatgaaaatcaacatagtcatattaggctatttcataattttaaattcatatccttgttgttttagatatttaattatttctggcaatgcttttgcagtttcctcttttccataagtatcatgcattaatattattgctttttctcttcctgatacagtttttatcacttcctgttttaactgttctgcatttttatgtgccccttctgcatcttgagacaatgaattccaatctatttgatggtagtctctttcatgaagagccttatccattgcatcagcgcccgatggatccttcttatcccacgtcatttgacctcctgggaatctaacagctcgtgtggaaaaatcctgtcctaaaatgtttttcaaagattgattagttttttcaaaatcagacatacaattttctaaatttatttttccatttggatataaatatccataattatgtgaataagtatgattacctattgcatttccttctgcaagttctcttttaactatatttttattagcttcactttcatctattgcttttcccacaagaaaaaaagtagcatgaacattttctgctttaagagtatctaaaacctttggagtcacagtttctgacggaccatcatcaaatgttaaataaacaactttctttccatcagctccatcaggcatttgccccttcatctgctgatttaaatatttttctataaaagcaacatcctctacttctgaacttctcgctgaattatatacgttactatctgtttgatttttatctccttcagaatatgcatttccatttgcattaagagcttctgctgtttgcctattcataacagatttttgtacagtaatagcgattcctataattatagctacagctactatcgtaagtaaaatagcaaattttcttttttttatacctttgaaatcttcttcaccaacttcatcgatctcaaatggccttatattatcactaatatcattagtctcggaattacccttattggttctagaattatcatctatatcactattttcaatagattcatcagcctcaccagcttcttttgcttcagtaaccttactggttccattactataattcatactattattaatgtcatcgctcatattataatacctcttatacttcaatagattttattattaattattccgtagtatctaatttagttattaataactttcacatccatatatagtataagtttttactctattttatacaataaaaaaaagccgatttctcgactaaaaattcttttattataaatatggctccgcgaagaggactcgaacctccaacctatcggttaacagccgagtgctccaccattgagctatcgcggaacgtcatttgaaagaatataatgttctttcaaaattgcatataattttaatgtatattacaacttgactatattggtcaagccctcgacctattagtatcagtcagctaaatatgttaccatacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctccacttgtaggtgtcgcagtcaggctcccttctgcctttacactcttcgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccaccaaggctgacgccctagtttcccagtctcccacctatcctgtacagacaataccgaaattcaatgctaagctacagtaaagctctacggggtctttccgtccaatcgcgggtagcgagcatcttcactcgcactacaacttcgccggatttgcagttgagacagtgcacaagtcattacgccattcgtgcgggtcagaacttacctgacaaggaatttcgctaccttaggaccgttatagttacggccgccgtttactggggcttaagttcacaccttcgcgttaccactaagtgttccccttaaccttccagcaccgggcaggcgtcagcccctatacatcagctttcgctttagcagagacctgtgtttttgttaaacagttgcttgtgcctattctctgcggcctgatttctcaggcaccccttctcccgaagttacggggtcaatttgcctagttccttaactgcaattcttccgtcggccttaggattctctcctcatctacctgtgtcggtttgcggtacgggcactacttctctctctagatgcttttcttggaagcatggaatcagatacttcggttccgtagaaccttccccatcacgcctcagaattgttggaacggatttgccaatcccaactccctaaacgcttagactagcatccaatagctagcacatcctatccttctccgtcacaccatcgataataacgattatagtggtattggaatatcaaccaattgtccatcgactacgcctttcggcctcgccttaggtcccgactaaccctgagaagacaaactttactcaggaaaccttagatattcggcctgtaggattctcgcctacatctcgctactaatgccaacattctcactcgtaatcagtccaccgctccttacggtacgacttcagcccgattacgacgctcctctaccgctcacgttaaacgtgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccggactgatagtatgtggcattcggagtttgataaggttcggtaagcgctatgcccctagcctattcagtgctctacctccactactcacattttccgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctctgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgattatcatagttttcacttacgggactattacccactgtggtccaactttccagttgtgttcaattaactatgatttctcgttatgttctgtccgcaaccccagagataaatctctggtttgggctctttccttttcgctcgccgctactaagaaaatcgatttttctttctcttcctccaggtacttagatgtttcagttccctgggtataccttcataaagctatgtattcactttatgatacatggggtttcccatgtgagtttcctcattcggaaatcttcggatctctgactatgtgcgtctacccgaagcttatcgcagcttatcgcgtccttcatcggctcctgatgccaaggcattcaccatgcgccctttgtagcttgacctaattattagtcatatcacaaagaatatttattcttggctttgttgtattttatatacattattatatgcaattttcaaagaacattgtggcttaaatgactcgaaccatcgacctcacgcttatcaggcgtgcgctctaaccagctgagctataagcccttattctgaagaaatcctcaaaattgaacagaacaaatacttaagtaacctttgagcaagtattttatattttgatacataatgatgtattgtactagtcagacatcatgctgatctagatttctccatagaaaggaggtgatccagccgcaggttctcctacggctaccttgttacgacttcaccccaatcgctgaccctaccttaggtcgctgccccgcttgcgcgttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagactggttttaaagtttggctccacctcacggtttagcatctctctgtaccagccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccccgaagggcttccccgattaagggtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaagtcgccttcgccactggtattcttcctaatctctacgcatttcaccgctacactaggaattctactttcctctcctgcactctagatatccagtttggaatgcagcacccaggttaagcccgagtatttcacatcccacttaaatatccacctacgctccctttacgcccagtaaatccggacaacgcttgccacctacgtattaccgcggctgctggcacgtagttagccgtggcttcctcctcaggtaccgtcattatcgtccctgaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcggattactcctttaattgctatgccatgcggcactacaatcttatgcggtattaatcttcctttcgaaaggctattcccctctatgaggcaggttacccacgtgttactcacccgtccgccgctaatccactcccgaaggagcttcatcgctcgacttgcatgtgttaagcacgccgccagcgttcgtcctgagccaggatcaaactctcaataaaaagtttaatcttagcttactcaaataaaaattgctggtttacttaaatgtatttatgttattctgttcaattttcaaagatcttgttgccttcaagcaactcatttagtttatcatcatccaaaatcaatgtcaacacttttttttaatttctagcatttttcatcaactctcgtgacaacaaaatctattatatcatcatatttattactcatgttttattttgcactattttaagataaatattctttattttctctctttttctttttattactcatttatcaacacagcgacacgcatggatatgtttaactatactttttatttattcacattaattagtgccgctatgtcatgatttcaatattcagtttttatttttcttttaccatattccaactctatcttctggtcttacatacattttatctccttcttttatattgtaagttttataaaaatcctcaaattgagataaaactgcatttacccttacctttttaggtgcatgtggatcgttatttaataaatactcttttaattcattcgttgatatttctctccatactgtcgcgtagttttcaaataaatcctttagattaggatcttccattttttttgcaatatctaaaacacaagccataccacctaaatcacttatattttctcctacggttaatattccatttacattcttttcattccccatatttatattagaataataatccaccacctttttactcctgtttgtaaattccttatagtcattttgattccaccaattttttaatttaccagtttcatcaaattgagcacctgtattatcgaacgcatgagtaagttcgtgtccaataacaactccaattccccaaggtttttttctttttttgcatttttatcgtaaaatggtgcttgcaatattcctgctggaaatacaatttcattatttaaagcattgtagtaggcatttacagtacaaggccccatgttccattcatctttatcaacctcatgatttaacttggaaaactgttttttactttgagatgtatatatacttattaggttatcaactaatgatcctccctcaccataggaatttattactacatcactatagtcattccacttttcaggataacccactttaacattgacattttccaattttctgagcgccttctctttagttgatttactcatccaagtattgctttgtagtctatcttcaaagttttcaattatctcttttgacattttttctacatcgttcttcgattcatcatcaaaatgtttatttacgtacaatttacttataatctcattcaattgtccactaacaaatttcacccctgagccttcatctaattccgaacattctactccataaagcacttttcttaattcattacacgcctctctatgtttagatgttaaataattatctgtgttcattaatacattggttttaaaatatgtttttatattttccaaattatcttcgctaataattgaatttactaactttaattcttctgggttttccactattattttctttggattattaatatttaatttatttaataatccaggtatatctgcattaggtattaacttatttaattcttttactgtatataaattataagaattctgtattcggttttcatctttagcttcctcctcataagaaggtatctttttagcaaattcattctcaatattaaaaaaagtttccgcatttttccttgctacatcttcattttctccatatagcatatgtaatttagctatataatttatatatatctgttttattttttgactcttctcgctagtatccttatagtaaaacgaatttcctaatccaagattacttctagaaacatataaaacattaatgttactattcttatagtctggaccgacgcctaagtttattagaggttgaaaatatgagaattcatcatccttcaatatggctttaagatcattcgtatccttaatttcatttatttgattcatatatttctctaagggttttgtccctaattcatctctttttttcatatctagatagttgttatataagtttaaaacttttaactcatcgctattcttatcataattgtctttatttttttgtatatctgatattatattaagaatatccccattaactctcccacatacttcctcaaatgttccataggaaatgtatccatcatcaagctttacctttgataaccattccttatttactgcattataaaaatcatcctctatcctagcatcactatatgattctatactattactgtttagaacacttattatattaaattctgagctatatggagtattatttaatgaagttgatatacttaaaaataatactaatattattgatgtaattttcttaagtgtaatttttctcatacgtctctctcctccttagtattttaattgtaattatctatttaataacgattccaatcgtttcacctaaagttagcctaatactattatttaatttattgctataaataattcatgtttttaaaataaacaaaaaaaaccatcttgaaatatcaatttatttcaagatggtttttgaattattactcttcgtaaatatattatttttaagatacgactcctgaaattataattcctatagaaatcataaaaccagctataactattgcaaccgcaacattcttctcttttaattcttgattaaaatcaattttagttaatactttatcaaagaagcagtatccgaatatcagcaatataatacctatcaatccaaaaataatactaactacaatattgtttacaataccagtcataaatctttcctccttattactatttaaataattagccttaactcatattcttctataattgtatatttttaatattacactaatcaaatttaaagcttatgttactactcaatgtatgtagcaacatatactgcatttttatcagttataaaatctcccattctagtaaatactcctgatggtatatcacctgttatatatgtacctattacaggaaacaagtatttgctttcttctttcattgttgaataaatatttgaatataatggtttaatatttactctatcttgaaacgctatatcatctaattctttactcatttcatcataacttaacataacacctgctccttcccttgaaagatatggcttggttacataatcaaaagaaagaacattatcaggctctaaacatgtatatggtatgtatttcaaaacaaactcctcatcatcacgtgaaaagaattttttcctaacaagctcataaataactgcgaatagagcctttgattgagttataagtgtatgtccaggatttattaagtactgtcccgaacttaaaggatcaattagttttttcatttcatcttcataagaaaaccagtccaatggataatgcctataaatggcatcaatttcattcccatagagataaattttattgttatttactttcaaatcatatatatttccaaaaactacactatactcattcaattcctttaatatttcagctattaaattgcttgtatatatatcctcataataccaagaagttacaacagcaatatttttaactttttttattttcttaagttcttctaatatattaaaaaatgatttttttatattctccttgagatttacattagggttttgatattggatattaagtttttctttaattatagaatttaatccaattgcttcaactaaacctgcaggtgtctcagaattaaattctaaaattttcaaacttccatcattatcaatagcaaaatcaattcttcctaatgcacaaagtgatgtagcacatgaagttgaaactaatttataaagttcttctggtatacctagtataggcccgaaaagttctatttctttttgtatatatggatatattttttttaaaatctcacaaaacttactacttactgaaagcatttctttataggcacattcttttaaaattagtgagttcaatgatatgtattcataaatatttgtgtaaactcctgtgaaattatatttaaatacactttcatctattatttcattccaaatttcttttctatttttaggattaaattcctttatataaaccgggaaattttcaactcctattgggcacatccacgtgtaatcatcattagttagaagttctctactccatctaaccaaaagtccctctactttataatccattatataaataccaaagtttccaaaggccaaaactggaatattcatattattattcccaggcgcataagtatattcttgtctaatatttatcaacttctgctttacatgtactttattgcttttagatacagttttaattttattttcccacatttcttgtgtataaagcttacctatgtaaacctcttgactatatcgacccaaggacgatttaacaacatagctgtccttattgattattacatcttgtatatcatcctgatttagtatttctgtgtacggaatacattttgtaattatttctttatccctaattgaaagaagctttgaatcagatttaaccagattccataaataagcgaagaagccttttgcctgaatagcaattactctaggatcgttaattaacaatagattcccacaatcaacacaattcaatatttcacttatattagaaatttcataaaaaaattctgtaggaaacaatcttaaaattattttaagcttaaaattagaatatgcataaacatatccatctcttacagataaattattgggtccaacttgtactatgttaatattagtatctttcaaaatatgtttaaagtaataactgtgatgtaattcttcataatgacacggatccatcaaaaatcccacatctattttttctttctccatctcatattctttacatatttttaataattctttaactacattatttataaaactaacatttatatttccatcaaaactacatttacctgctaaatcaatttctttttgaccacaaggtttatcataattaaattctgcaaaataaatatccccatcaacgtctctaaaagtatcatatctggcccaaaacatcggagacattgggcatttcaagttaaatattttttctttaaacatgaaatcatcaaaataattcaataactcactatgcccttccttaatgttcttaagtacatttaatgaaattctatttatttcttcactataaaacaccattttttcataagttgatttatcaaaataaaacggtatttgcgagtgaacatactcttcacctaaagaactcaccatatagttattaaataaaacatcttcagtataattaatctgtttttccatagagtaatccacatcctaaataatttctttacatacataaagatacttaaaattttaattatcttatcgcttatgctaacttgatgaacttccgccctttgatccagagtatcctgatgatttaccaactgacgaatctgatatgctagctttgctcttgctagaagagtcactatttatagatgaaccactgctaaaactattccaccctccaacgtgcccaccgccactataattagaaccatttccatcttggtcttcgtcatcttctttttgagggttgtaacagcctgtaaatccaagcggtccacttacaaaaaatgcagcagctaccgcaatggataatgctttcctcttatttttctttactatctgcttgaaatctttcattatcccctcacctttatcacttctacttctatatcctcatttataaaatttatataatcctgtaagtcatctttaatcttatttatagtcaaaatagttattttagtgtatccaagaatttttagtatatccgcacttggaagatcatcatcactcattccatattgattattcaatttatctttcaagtcatcactcttccaattatcattatacctatcatacggtatcagcataataaacttttcagtacttattttctttaaattcaaaccattatttatcaatttattaatattctcttttgtccctattattccaaatggatggaataataaattaatatttagaatcggttttataaaatattcattatttaataaaaacgctaaatttaaaatctcatcaataggtaaatcaactataaaaaaattattcttactacagttttctactattatatccaatatatatttattacattgacatgcattttcttcttttaatataaaattatcatatgtttgaagtgaaacaaatggtgtacttctgaagaacccttgaaatggccctaaatttgacttccatattgtatacacctttcttaaatctatatcttgtagatacatataatcctacctttcatatgttactgcataaatttcacataaagatatacactgcttaaagccctcttgagttataaagactaagtgactatctgcggattcactttcacatacttcccccataatggtaatttccggattagagttttgccaagaattaaaatttgaataaatattgatttctttagcatatgataaaaaaccatatgaaagcttataaacaatcgcaaagttattttttaatgaaagtatttgcctatacctcttgaattcttccaatgtatcaataactaaaactccattgtatatagaattcacctcgccctccaatgtctcagtaggtttgtcatcaaaccactcattataagtcctataaataaaaatctccattatttacccctcatttactttataatactaaataaatattactcatatctatcatcacttacatgtcgtgctctgcacagatcattacgcaaatttacaaatttaataatatatatctgaaaactcaatacttatcttttctactttactttcatataaacgtccatctgatgatagtttatcttcaacaaatctaacaggcaacttgactacaaattcgcttccttttccaaattcactaaaagccttaatatctccattatgcatatctacaatagattttacaagggatagccctataccactgccctggctattgcgcgcaagtgttttgtctatttgtccaaatctttcaaaaatcatatttagtttatccttcggcattccaacgccattatctttaacagatattacaatattatcttttttatcatacatattaaccaatatctgtcctcctttatcagtaaatttaatagcattggataataagtttaacattatcctttcaattttatccaaatcgattgccatatccttttcttccacatctgtatcaaatattaagtcaatccccttattatttgcataatctgcaactgataatgttatatcttcaatgacacttacaacattatagttttggagattcattttaaagtatccagaatcaaactttgatatgtcaataagattatttacaagtcttacaagcctatagcaattttgtttcattgtttttaagtatttacctgattctaacttatttttatcattgcctgacaatgataagatctgaacagcccccagaagtacattcaatggtgttttaagttcatgggatatattagaaaagaattctgtcatcatcttattaagttctgtagccttacttatcaattttttgttttcctcgatgttactttctaaaagttgtatttgttttcttgaggtaatatccctgagcatgaccatagcagaaggttgtcctttatacatacaaaagctatttgtaacttcaatgtccacaattttcccatcaagtctcaatagcttgctttcaacaaatggtgtacttaatttattacatatagcattatctattcttctataaactgcacctttagcttcatctgtaattattttctcaatatctattcctatgatttcttcaaccttttccgctcccaagagttcagccatcttctcgttcgcaaatataaacttattattactaataacaaaaattgcattgtcagagttgtttattatcatattaagacattcttcattattaaatactatttcttcaaataatttcactttattatcagccgtatataaatcgctattcataagattatatggctttctaagtcctgtctctacaactcctttgtataaaaaatatgcagctaaaatcattatagtatgtcctattatagtggtaaattctgacggaactacataacttacaaaaaacatttcgcatactccagataatataagaaaacattcaaaacatacaaataaatacttatcaatattttttccgaatataaaaaatacagtagcaattattaaaaatgcagtacacaatacatattcactaactattttaaaggaggtcaaccccacattttccacataacaatctggaaaaactttaaatatacatattgacgatatcaaaaatattgttatgcaaaaataagtgatgaatagtgcgtacggattcatattcctttgtgggcttattttaaatattattgcaatcaaacatgtaaaggcacccatgtatcttgaagcaatccaaaattgggttgctatctttaatccatccatactgcttaagaaaggcattccagtataagtaagcatatgaaatattcctagtactgctacaaaaaagtatccaattcccaatattaataggaagttgttcttattaattctataagtattaaaagcaaatacaaatactactgcaaaaataaaattaataaacaactcgattccagtatgaaaaaataaattactatagttattcataataatcagaaatgccataaaaataaaaaaaaagctccattctatcaacaactcaaatttgatagattttgaaagccttctaattcctcctgtactcacaatgtgtacctccttataaacgtttcttaataaaattatctttagatttgtttaatcatctcactattctttattttactacttatacataaatatgtaaatgtattcgttgctataagaaagctctaaaagctttataacttcttttaaaaagttacatataggctctaaaaaaatactaatcataaaacacctcatgaatatcatattcttcacaataactctatatactgtaaactttataagttagagcctatatacatttttattaaacttcctataaatatatccttttattagctttcatttcttgcataccattttcttatgatttcaacactttcatcacttggataatactttttatcatcactagtttcacctattgcaaatatagagaatccaagattccaagattcattttcaaagacacttctatatgcttcaaagcaatttgcctgttccttattatttacaatatcagaaatcaacggattatgtggttgaacagaagccttattagttcttgggaaacctaattctccaaagaaaattggcttattccatttatcatagaagttttttacttcctgctttatattttgttttctatcatatatttgggtacactctaatgaacttattagattttctacagtattagtgtcattagaagtaagttcaaaataagatgctatagaaatgaaatctacctttgaaaatattttattatttaatttttcattatacttatctgtaaattctggtgagaaatctttcgctgtaacccaaaaatttgttctataagttaataaacctttgtagcgatttctaacataatcaaccatatcacacattttctgctcattagattccatatacacaaaactagtccctatgtttaatgcgtcaacatggtatggtatggctacatctttaattaaatttcccaaaacattatcagtccagttattaaaaaattcatctatattatctggtttccattctgtttctcctatacttccgttttcaatccatggatacggttctaatattatatttatttttttccatcttaatttttcaaataattcgatagccctcttttcacttcctttatctattgtcatattactagaagttctactatctatatttataactactggaacatttaaagtatttaactgcaatttatctatatctttaagcacttgatctatattatagtcagttgataaatttccagatttaatttttgtttgaaattttgaatttaatgtttttccttctatcttattaatcatatcattaataaatcccctggactctccgttaatgttataagcataaaaaacaaatgtaatcatacttaaaattataaatattaatactcctcttttagtcattttaccacctactctatcagttaatcgtatattatttccatacacattcattactcagtttgcgtatttcttaaattacttttccaaaaattttaataatctagaaaactctacatttgtttcaaatcaataatttaagaatttttatcgatatatatttttagtgctttaattaataaaataagtgcataaatacttaatactcttagaagtataggaattataaataaaagtggtgctaaaaactgttccccaaatggcattgaattcatttgaattcatttgaatttaatgatacaagacaccaacctcctattatgccaaacaaaagacttaatcttctttccaacgcagaacacctctttcaataattagtagcaaacagtaatttaccatatatattaaactataacatattttaagaaacaaatcttttcaaaatttcatttaggggaaattatgtatctaaatggggactgtatggtgttaatttgttcaataaaaaattccccaaaatagggggaataaaaaactatcacaaatcatcttttgattaatatttcaatcataactaaattatttttttgctaacaaaataacagtattagtatatttccagactttttctacagatttaaacccagccatattcaacatttgcatctgattttctacagtacacggagtatcatagtgatagaaaccagtagttatacctaattttgaacgaattcttctattttcattaaagtaataatcctcatattcttgattcggtgccatataatctgcttcaatataaaaaccattctgcttcaagcttctaaaaatcttcttatacaatttaatcttttcttcatgcgcgaaatgatgaagcgtttctacagataaagcacactcaaacacacatgttccgatgtcatactcaaagtagttaccaacaatgagattaagctggtttaatttatcattatgtttctgttttattttttccatcatattcttagctaaatcgattcctgtaactttgactgttgaattaactttaaaaatttcatctaattctaagcctgtcccacatcctaaatcaagcaaatttagttcatttatttttggtattaattttgcaatttcactataaagttcatttgtaccctcaacattattcatcatatgctgctcatagttctcagatctgctattaaaaaaactgctcatttcttctaattccatttaatcatctcccaaatgaattcctgtaagttagtaaatactacatttaaattatattattttaatgtaataactaacaacctcagaaataattctgaaaaaacaatgcgccataacttataattacattacggcacacacaattcttattctttcttttttatttgagaaatgattctttgtatacttttttctgatagataatatttactagtaagaacttttatacaaataccagatttataatctttgaatatgtttgtatttctaattgcaatttcagttctactctttgtgctttctccccaactctttttattgcattctcgtcgcgggatatacaaatattctccatcaatatagttttgaattaaattcaataattcctttggtaatatctcggttgcttttatatagctcattttgctcctcctaatataattttatcttaggattaagcaaaggctaattcatgctttttgttttatgctatagcctttgctatgcatgaataatatattttctcataaaagtactacgcctcctctcctgtcttaactcaacattaattactattttatgttaattatacaatatattgtaataaatatgatactaattctctttaattattgattgatcccttccctatatgcttttaattgtcttttatattgatctgtcttatgaaagctacatgacttatactcatagcaatggccacggcagataaataaaaaaggtgcacggataaccccatacaccaataaataatattaagcttttgcattaactaaacttatgcctttttaatttactattcttaaatcacatcttatataagctcttaattctttggaatccatcttgagtatacccccattccatttgcatatccttgttaattcctaataacatacattctctatgacaaactaaggctttattatatgctgtattgttactttctgatattgtgcaattgtctaataatcttggagacactataatatttatcgttagcctccgtaatcattggtaaatctattttgtttggccgcaacaaaaaacaccaacgctctaaatttctttaggccgctggtattcctcatgtttggtacacttggtgggattcgaacccacgacttctggattcgaagtccaacgctctatccaactgaactacaagtgcatattaatttttatataaataaaaacaactgaaatcagttgttttttggagcgggtagtgggaatcgaacccacctttccagcttggaaggctggagtattaccgatatacgatacccgcatatttatttatttttatataaatggagcggaaaacgggattcgaacccgcagcctccaccttggcaaggtggcactctaccgttgagtcatttccgctcatttggtgcagatgaagagagtcgaactcttacaccgttaggcgctagatcctaagtctagtgcgtctgccaattccgccacacctgcatgagcttttttatgaatttggtggctcacccgggaatcgaacccgggacaccatgattaaaagtcatgtgctctaccgactgagctagtgaaccaaaatattggcagggatagcaggatttgaacctacgaataatggagtcaaagtccattgccttaccgcttggcgatatccctgtaatggaatgaactacacgttatcccaaacttttaagtaaacaataaatttactattggtgcgtcatcagggattcgaaccctggacaccctgattaagagtcaggtgctctaccaactgagctaatcacgcataattggagcgggtagtgggaatcgaacccacctttccagcttggaaggctggagtattaccgatatacgatacccgcatatttatttatttttatataaatggagcggaaaacgggattcgaacccgcagcctccaccttggcaaggtggcactctaccgttgagtcatttccgctcatttggtgcagatgaagagagtcgaactcttacaccgttaggcgctagatcctaagtctagtgcgtctgccaattccgccacacctgcataagtttttatgaatttggtggctcacccgggaatcgaacccgggacaccatgattaaaagtcatgtgctctaccgactgagctagtgaaccaaaataatggcagggatagcaggatttgaacctacgaataatggagtcaaagtccattgccttaccgcttggcgatatccctgtatggggtgaacgatgggactcgaacccacgacaaccagtgccacaaactggcgctctaccaactgaactacgttcaccataatggtgcgttttaagggattcgaacccctggcccacgccttagaagggcgttgctctatccagctgagctaaaaacgcatatcttttattatgttacaaatattaaatttgtatggagcgggtagtgggaatcgaacccacctttccagcttggaaggctggagtattaccgatatacgatacccgcatatttattttttaaatggtcggggtgacagggattgaacctgcgacctcatggtcccaaaccacgcgcgctcccatctgcgccacaccccgatttaatggtgcgttttaagggattcgaacccctggcccacgccttagaagggcgttgctctatccagctgagctaaaaacgcatatttaattgcttttcagactttttttattttactctattcaagcaattttgtcaagaactttttcttcggaacgttttttattttacatgttccttcaaactttgtcaaggctttttttaccactttgattaatatcataatttttaatggagcgggtagtgggaatcgaacccacctttccagcttggaaggctggagtattaccgatatacgatacccgcaaatattaacctttaaatggtcggggtgacagggattgaacctgcgacctcatggtcccaaaccacgcgcgctcccatctgcgccacaccccgagaatcttaactagtttttcaacttgtcactcatctctcagcgacaatgattattctacaatatcaaatctgtttcgtcaataccttttttataatttttcataataaatttaaatatttaatcattattccctaatttcttttaaatatgcatctacttccccattattatcgatgtttataaaacctatacatctccctttaaatttaggtaatgatatacttcctggattcattaatatcatatcatcttctttctctactaattgctgatgtgtatgaccgaataacacaatgtcagcatttaattctcttcccctataatagatattattcatagaactctttaccccatataggtcaccatgtgtaaaaaatatcttttttccattcacttctataacagattcctttggatacttagttgaataatcgcaattacctgcaacagcatatacttttcctttaaaagtattttccaataattctgcatcatcaatgttatctcctagatgtatcaaaatatcagcatcctttattagcctcttagccaaattaatatatttagttatcctatgtgtatcacttacaactgcaattaacataatttaatttctcctcctgcattattatttatttaactcttatatagtaaagagcctatttacctggaataactttctaataaattaatttattaattaccttttttaattcctttaatgcctttcctctgtgacttatttcatttttctcctctgaagttaactctgcaaaagttttatctaatggctcgtagaaaaataatggatcatatccaaatcccccatctccatgtagttcttctataatatatccttctacttcacctgtaactttaaaatactcacccttatctgtaaacatagctaattgacagataaacttagctcctctattgctttttaaaactccttttaacttgtttaaaagcttttcattattttttgaatcatttccatgttcccctgcatatctagcagaataaattccaggctccccatttaagtaatttacttctaatcccgaatcatctgctaatacaataaaattactatcttttctttccaacagatattcatatatttcctttgctttcttttttgcattctcttcaaatgtttttccatcttcaactacatctatgtctatacgctcatcttccaatgatctaacttctatatctatctcttttaatatttctttcatttctttaatctttttcttattattactagctaatattaattttttcattatatatctccttttgctcatttacaataaaaatttcaaatttcataattactctataaagtgctttaaaaccactggttcttttgcttttctatcactaataatattatcactttttcatttttaagtaacctaattaacactatatattcctaaataacctttatataattccaactaatttacttgaaacacattaatcttttagcattcttactgtatattaaataattcatctcttttaggtgcttcaacctctatttcaatatcatcatctattaataatgctccactctcacatatctttcctattatactagcctcaattccactttcatttagaagttttatcaacccagtaccatttttagtagtaataagcatactcccagacgatatgagcctaagtggatctattttgaattcttcgcaaacctttttagttatatccaacattggtattttctctttaaatattttaaagcctttatttgatgccatagcaacctcaaaaagtcctccaagtagtcctccttctgttatatcatgcattgaattaacgccaaattctccgcctatttttccttctctaagaacacttagcttattgattaaattacttccaaattctatctcctcttttgataaaattttctcaattcttgctttatggtcatttattaagatatatgtaccctctaatcctaatgttttagttactattatgtcatctcctaattgcgctcctgcagtttttacagatttaccttttaaattctttcctatcactgttacggatataaccatcttatttactgcgcttgttacttctgtatgtcctcctataatctctacattaatcttagctgcttcttcattaatttccttcatgatttcgtttatctctcgtaatgttgatgatgttggcgctaatattgtaactaaaatacctataggctctccacctgctgatgctatatcattacaattaatatgtactgctagtttcccaacattctcacttgctcctgttatcggatctgtagaaaatattccttcatattctccaaaatcaataatagagcaatcttctccaacatcatttctaatctttacctcctttctcttaattgttttattatttaatatgatatttctcaaatcctcgaaatctaattttccttccttcattataaaaaatctccttttatttttattttatgtactttttgtttacaaatttcatattaatgaataagatgagaattttatgagaggtgttatacattgagatatataggaccattttttaggatgaacagtctttcccaaaaagaaattagtggtcaacttttttacttatccaaagaatcaataaagactttggttctaaactctaaatgcggaattttagctcaaactagagcttcaaaaaaatctcctatagaagatattagcatattaaataatttttctccactattatgcttatacagaaaagcttcaccgttatttattcatagtaaaagcagccctagttttgatgaggcaagttttaaaaaagaaataagcccttctactagtgctcttatgactttatgtttacttgaattaagcgaatattattcacattatagtgatgggaaaagaaatatagtatctcttgagaaaccatttaaattccttgctagagagcagttacaattctattctgaaaacttacgaaataatgaaggcttatttgtagataaaaaaaatatatctgatggaaattccaagggattttctttaatagataaagatgataaatttaaattttcagatcaagcttttatgatggctgcttacttactatactcacattataatgatagtgatgaacttagcaaagattatgctgcattttcaaacgaaattctagatatgtttaaaacttataattctgtattatatgatttatcgtttagtgaatgtatacaaatttttctcgctctaaatattcattataaatattcgtgttcacaaaatgcgaaagaattaattttagacttgggtgactttttgatttctaaatttcaagaaaaagattactatatggattctatagatgattgtgcattattttctatctgtctaatggaagcttataaacatacagaaataatttcttttaaagaattttctaaagaaattactgaaaaactgattggtttatatgatacagataaaaatatatttataaaattgtctgataagaaagatagtaaatactcttgcattgaaattaatctataccttttatgtttacttatgtattcatttcaagaagataggatttcagaactacgacctattatttctggtctttatagaaaattcttcgtaaacggcggtcttttaacaagttggcctgaagcaccaaccttagacgaagtagaacgatataagaaattaagcctacgttctgatgatatgttagatgagatatattttagaatgccagtattacctactcctaaaagcacaggtttagctcctgtatttgttaaaagcttaagttattcaaagaaaaaagattcattagctactaaaagaacttcttttgatagtagcaaaaatatgttcaacttctttatgattatctaccttcttaaagatatggttgaagattttatggaatttatcccaccattaggattagaaagactctctgatttagatagctctattgactcaaatactggttttgcaacaactgacgcaaaagaaagtaactctaataatccattagctacatctagtccagagagtaatgtaagtaacataaagacacaattaaacttatcaaaatcagaagatcctgttgactttaaacaacctgtactcaatagctttaatactttcaaaaaaaatactaatatatcttcattaaacaatgatagtacgactaaaattaatcattctgttagaaataaaaaactaaagaaaaataaagcacaacatccacacagtaagaaaaagttttaagattcatagatatggatatgacaaaaaactatccttatatgtaaatcaaaatataagatttacatataaggatagttataatacgttgtattgaaaacatatgctatagacaatcattaatcttaaccttaagactattgctattgtattgtagcaaaatttatattaccatttccatctaattttagatcagatatcttatcagaaattgctatattttcattataaaacaccaacggaagaatatcgtagttatcaaatagattttcttctaagcttgaataatctccattattcttagtgattaataacttttccaacaatttattctggtcttcagttagatattttttaaagttattataaaaatctgttttctcagatgaattggcattattattaaccaaaatcatatcgtatctttttttcaattcttcatcttcgaattcttcttttactaaactatattttattgttatatttgtattatttttaaaccagtcttcgattgttctacataaaattctattctcatcagtatcttcacatagtaatgttaatatcttaggtttgttccattcaccttctttattgctaataactttccttgcttgcaattttgttagatcctgtttatcctccctaaaaaaacttccctctgcaagttcaaattctttattatttgaattttgatacgattctgtagctttacatacatcattataaatatctcttcttccttgaagaggaatagagttacttttactgttaatgactaaatatgttccttttgtttcgggaagtgttattaattttttctgctctgataatttattaagttcactttctggtggatttattacaatatccctttctttaacttcatatgatgccatagatgtttctacactatcatcatttaatattttaatagtatctataccacttttattattattctcatttctttttaagacaacctgatctttgttaaatgaatcaatcttataatcaccagagtaaattaatttactataattatttttcatattacgccacattattaaatattttcttagtgtatactgtggtttggccaattcatttaagaaattatcatccgctttattcaatctaataataacagaattctcatttacttttattgcaactccagtttcatatacaactttcccatctctaaattctttagctccataaacattaagcaatgcttgtatattttcttcatcttcttctttcagtaattctttaaagaaagtagctatatcattgggagttattttacttccgtcactccaaaaaatatcatctctaattttaaactcatattgaatgccatccttgctttttgtaatttcacctgctaaagatggtactattttattatccacatctttagaaaccagccctttgcttactgcacatataatatcctcatggcgtttagataaattagtaaccttttctaagtcttctggaatctcatttataccataacttattgtttcttgcgaatcatcagtagataaattgttactttctttgttcacaaatcctaaacaaaataatattataaaacttaacataattgcatagaaaaaaattcttttcataattacaccctttgccttaatttatattaagaattatttccacaatttactttgtctaatcaaaaaactgactcaaatgtttttaaataactttgagtcagttccttaatcaaaaacttctgctgcaaatcaacagctgctaagttcgttttaatcaatattttattacttaattaaatttatcataaagaaaattaaagatattgatattaaaaaacttaagatacaatatactattctcttttttcctgtctcgttaataagaaacctaattgctaaaattgccatagtgatacagactccaagttgtatcggtaagtatgaattaaaaatctgaccaacataataaaattgatatgttgtcaaaaaagtacaaattattaagatgcttgttataaaagctgatataaattcaagcaaatttattaattttttcatactctacctccttagcatttcttcaaactcatcttccgaaaggatcttgattcctagttcctctgctttagttaattttgatcctgcagcttctcctgctattacataatccgtttttttactaacacttcctgcaacctttgctcctaagctttcaagtttatcttttatctcagttctagaataatttttaagtgaaccagttgcaacaacagtctttccttcaaaagcacttgctatcacttctttttcttcatatttaggactgacacctagagataataattcttcaattgtttgtaaaaccttttcctctttaaagaatgccaaaaccccttgagcaactatatctccgacatcctgaactccaacgagttcttcaaaggttgcatttttcaagccttctatagattcaaatctgctaactaaatcttttgcagtctttactcctacatttggaattcctaaggcatatataaatgcgtataactcacaatctttacttttttcgatagcttccagaagattttgcgctttcttagctgcaaacttttctaatcctattaaatcctcttctttcagtttatacaaatcagaaatagatttaatattaagtttttcaaatagttgttccgctgttctttctgaaaaaccagctatattcattgcttctcttgaagcataatgaactatagttttaactaattgaggcttacaagataaagtattttcacaaaaataatgagctccatttaacactaaatgactgccacaagcaggacaaacttctggaactgatatttcctctgaaccttctaaagattctggtactatccccattatctctggtataacatcgttacttcttcttacaaatacttctgcaccaattctaacaccttttcttgcaatatcatccatattatttaaagtcgctcttttaacagtaacgcctgcaagttccactggctctaatattgctgttggaccaactctaccacttcttccaacattccattcaacatctaaaagtttagttgttgcttcttgggcttcaaatttaaatgcaatcgcccatttagggaactttactgtatatcctatcaattctcttgttctaatatcatctattgcaattactaatccatctatatcataatttaaatcaaatctaatatctcttacataatctatctctttctcaatttcttctatagacgtacatacccttatataatcatcaacagggagcccttgctgttttataaactccatcatttccatataagtcttaaatggagttccttctttatagcctacatcataaaagaaagctgaaagattccttcgtgcagtttcttttacatttaagtttcttaaagcgcctgcagccccatttcttaagttctttagtggtgtatcagaagtctcattatatttattaaacgcttcttgcgtcataatagcttctccatgaacttctaaaatatcattgctattaattttaagtggaattgattttattgttttgacctgtgctgtaacttcttcaccaatacttcctgttcctcttgttgcagctatttcaagtataccttcagtattatatgttaagttaattgttaatccatcaaatttctttgtaacaacatactttagatcaggcagattttcgcctctgcccctagcctcttctacaaacttaacatttctattatgccaatctataatttcttgcaagctttgcgctttatctaagctccaaagccttgctttatgtgtatacttcctaaatccttctagcactacatccccaactcttaatgtaggcgaataaggaagtacatattccgtttctctttctagctcttgaagttcgtagtatttttcatcatagtccttgtcgcttacagatggactatctaaagaataatattcatatgaatatctatttaacttttcaacaagttcttttatcctttcaatcttatccatattagcctccaaatctccactaaatcattttaagttttgcaaaagataataataatgacttaacaccttgtttatcgaacgcaaccgttaatttcttatcgttacctgaatcctggacagccacaattgttccttttccaaacttttcatgaattacttttcttccaagggttgcttcactaacagatatatattctttagccatttcattcatagtacttctatcaattacattattaatcccgccattattaagagtatatgctctattacctgtaacactatttcttaaactgtgtgggttagtgtaggaattgctttgcatgatcttctccctgcttttagcactttcctttttaactccaacatattcttttaagtctggctttatttcattaataaaatcagattgaggatatgctactgttttaccaaatactctcctaacctctgccgaagtcataaacaatgtctgttttgctctagttataccaacataacataatcttcttgactcttccatctctgattctttttcaaatgacgcattccctggaaaaataccattttccataccaaccataaatacaacggggaactccaacccctttgcactatggattgtcattaatactactgcatcatcttcctcttcaatcttatctgtatcctgaactagagaaactctctctaaataagcagataacgatttgtcttcattgttcttttcaaaatcagctgcatctgaaacaagctcttttaaattttcaattctactcttgtcttcaatttcatttgattcctgtaattgttttagatatccagtatcttttaatattgattcaataagtactgaaacagggactgtctcactgagttccatgaaattttccatgagcgcaacaaagggttcaattgttgaaacatttcttgacgttaatgttggaatactccttacttcagctaatgcgtcccataaatcaaactcaaagctgcttgcaaattcttgaacctttgcaacagttgcatcaccaatgctcctcttaggtacatttattattcttctaatgctaatatcatcttgaggattaacaataacttttaaatatgctaatacatcttttatctcttttctgtcatagaatcttgtgcctcctactattttataagggactcccttccttctaaaactttcttcaaaaattctcgactgagcatttgttctgtatagtatagcaaagtcattataatttttatcttctttattctttatatctaagatttgtttactaacaaagtctccttcatcactatcagcataggccctatatattttaattttatttcctggctcttgttctgtccttaatactttactttttctatttgcattattaacaattactacattagctgcacttagtatatttccttttgatctataattttgttctagcttaattactttagctcccggataatctttttcaaaatctagtatattttgaatatccgcacctctccactggtaaatacactgatcgtcatctccaacaacacatatgttcttatattttgaagcaagtaatttaaccaactcatattgagcgccattagtatcctgatactcatcaaccattatatatttgaatttattttggtaaaactccaatactccaggattatttttgaaaagctcaactgttttgaaaattaaatcatcaaaatccaacgcgttgttttcttttaatctcttttggtacatttcataaacatctgcaattttcttttccctaaagttagcttcattttctaacataaagcttctaacactttgcattctatctttagcttttcctatctttcccattatctcttgttctgttatatctttatcattaatattaagtgttttcatacactctttaactaatgtcttttgatctgagctatcgtatatagtaaaactacttttgtagcctatcttatctatctctcttcttagtatcctaacacaagttgaatggaaagtggatatccacatattttctgctctttcaccaataagtgccttaactctatccttcatttcctttgctgccttatttgtaaaagtaatagctaatatactataaggtgcaatatctaaatcttcaatcatgtgtgccattctatgtgtcaaaactcttgttttacctgaaccagctccagctaaaataagtacctgcccatcaattgtagttgccccttcatattgttctttattaagtaatgattttaaatccatttacttattcctcctttcccaatccttaaatattataccatatgtgcttatgtttaaatcattaacctaactaaaatattattttaattgcatatattcaaacttatattctaggttagtctatatctacattagaaaaattataaatttttaggaataaaaagcacttgatattttaatcaagtgttactcacgcattacttagtaatttaatacttttactcatcatatattaatcactctaacttttataattcaccaatataaggaactatattctaaagtttaggatgtctttttctaataccgatgaaatattaactagtttttttgctgtcatagaaaattcatttgttatagctgcttgctcttctgtagctgctgtaacctcttctgaaagggctgatatttcttgcgattttgaagctatattttcaactgtatttaagatcttatttcttcctttcatagtttcttgaagtaccacatgaaccatattaatatcactaggaatattattaaccttgctaataactccttcaaatgagtttgttacggtattgatatcatttttactttcttctactattttagttacagcctctgtagtattagaaacatcatgagtctctttcataactgtatttattaattgagttatgctttttgatgaatttaatacttcttctgcaagctttcgtatttcttctgccactactgaaaatccttttccagcctcccctgctcttgctgcctcaatggatgcatttaatgctaaaagattagtttgttttgcaactccatttataacatcaactatggaattaatctgcgatatagtgctatctaaattttcaacctttgctcttgataccgaaaatgaatttaacatatcatcgatagtgttcgctagcttatttatagtttctgctcccttatttgtatcatcttttattacttttccaccatcagctaataatgttaatttattatccacattatctaaatctattgaaaaactttctaataagctaacagcctcttctaacgcttctgcttgttttataccttcttgagatacattggttactgaagttgcgatttcttcactagaggatgctacagtgctgcctccaatttcaatatcctttgatagtttagccaaactttctgatattacttttgtttttctaacaagctccctcatgctctttctagttttactacttgcagctgctaattttcctatttcgtctttacctgtaattttatattctgctgtaaaatctccattccctgctttttcaataacatccttaataatttctataggttttgcaattcgccttcctatatatactcctacaacagctgctaatatcaatactactatggcataaattatgctttttataatagtgcttctaatagacttttgcatgttatcaacagaaattccgattgaaagagcatatcctatatcatctccgtctttgacaggaactgttacattatatgcaggagtccccttccattcgtacatatatgctcctgtatcacctttaaatactgcatctaatcctgttgaatcaatcttctctccaattgattccttagatgttcctgcaacaagagttttatcacttgatattacacctatgtagcataattctccatctgaatatttatatgtttgatctattattccctgtattttatctgtatttgtaactcctacactttctatatttgcttttatattattaactaaaataattccatctgctttcatttggttttgtattccatttaccatctggtatgaaaagaaagttatacaaattaaagttattattgctgctattaaaacaaaattaaagattaatctttttcttattgaattaaacatattacccctccctaatattttagtatctaccttaatatcttaattataatttctatatgttttttatatttcatttagtacccgaaacgaatcttttcagcatatacttcgttcgcgtacgaagcatatgccaactttaaaaacattttatttacattaacttattaaactctttagttttacactcctatgacttctgtaactccaggaacctcttcctttaatttttgctcaataatcatttttattgtcatcattgctcctggacaatttccacaagccccttgcatttttacacttacaactccatcgttgctcacatccactaattcaacgtctcctccgtctctttgcagcatcggtctaattttatctagtgatttcattattaattctttcataatctacactccttctcttatattcttcgtacgcgtacgaattatctatttaaaaaaaatgcctttagagcatttttattatatttttaagagctttatctatattatcttcaaagacctttttttcatcttcaccaaaatcttttaatattatatctagaaattctctttccataacttgaagtttttgctttataactacagcttcaggagtcaaacttatatatacacttctcttatcttcgctacacatgcacttgtttattaacccctgactctcatacttatttatgatgtcagataaagatgattttgatattttccatgtgcttgctatttcattaaaaagcaacttcgaaccatcttcaggtaatatatcaaatagtgctgcgtgattttgcaatataggtagtcgctcatcccttattttttttgtcaaaaatttgttggacgcttcaacaattatactcattcttccaacgatacatttgtttttcatttttaccacctcgttcgttcgggtacgaattaattatagaattttaatatttttttgtcaatgctttttttattttattattttaatatagtcttaaatttttattctcattaaaacgctaattaaatattttatttcttttctaagactttaattctgattgataattcagcccccaatcatacatagatttaattatcggtgacatagactggccaagaaccgtcaactcatattcaactcttggaggaacttccgcataaactgtacgttttaatattttatctctttcaagttcacgcaattgaagtgttaatgttctatgtgtaacatttggaatcaatttctttaattcattaaatcgtttcttgccgcctaataaacgatataaaataatgcccttccacttaccactaattatatttagtgttgtctctactgggcatggatgattggggcaatctggatatataacttgttcatgcatacttttagctcctttagtataaaatagatacttaggtaagttcatttatattatatatcaaatttgtgcgtacttcaatgcagtatccaattgtgttagacttagcttatacttagataagaggtggtttttaaatgaataacaaaaacaaagaaattatagatgcatttcaatttcgtcatgcttgcaagcaatttgaccctacaaaaacagtatctgaagaagattttaatactatattagaagctgggcgcctttctccaagttcattcggttttgaaccttggaagttccttgtagttcaaaataaatctcttaaagaaaaattatttcctgtatcttggggagctcagaatagctttagtggggctagtcactttgtaattcttcttgctcgtaaaaaagttgatacaatttataattctgaatatataactaagattatgtctgaagttcaaaatcttcctgaagatgtagccaatcaaagaaaatcagctttcgaaagctttgagaagaatgatttcaatttacttgaaagtgatcgtgcaatttttgactgggcaagtaaacaaacttacattgctctagcaaacatgctaactgctgctgctttcttacaaattgattcatgcccaattgaaggatttaatattgaaaaagtagaagaaattcttaagaatgaaggtattttagatactgaacactttggtgtttcagttatggctagctttggataccgcgctaaagaaccacatgaaaaaacaagacagccattaaattctattgtacagtggatataaatctattgaaagaaagccatgcatatgaaataatttcatttatgcatggttttcttttataaatattataatttgtataaatcctattagttttattaaaactaaaaatgaagtagataaattacaagttatgtatccatgtgttaagatatttattattatggtacaataaatcaatgtataaattaaagcaaacaaacgattggagtgaataatttggaaagattagataaaataatttctaatttaggatacggaagcagaaaagatgttaaatcttttgccaaaaaaggaattatagaagttgatggtctaatagtaaaagatagcgctatgcttgttgaccctgaaaaatctgttataaaaattaatggtgaagaggtactatatcgtaaatacatatatataatgatgaataaaccagatggagttatatcagctacccatgataatagagatgaaaccgttattgatttattaaacctagaacatcaggtttttgacccatttcctattggtagattagataaagatactgttggattattgttattaactaatgatggtgaattaaaccatagattgatttcacctaaatggcatgttgataaagtatattatgctgaaatagataaaagcgttgatgaaaaagatataaaagcctttaaggatggaattactttagatgatgggtataaatgtttagaagctaatcttgagatattatcgagcagtaacgatggatctgaaataaggcttacaattcaagaaggtaaattccaccaagtaaaaagaatgtttgaagctgttggaaaaaaggtaacttatcttaaacgagaagagttcggtgggttattattagatccagatttagaagaaggcgaatatagagaattaacagatgaagaattaagccttttaaagagctattaacgaatattaaataattttgcaataaaataattcatttctttcaaaaatattcacattttttattaaatcacttgcattattaataataataccctataatattcttgcaaggataaataaaaggaatatatagccccctttttatttattgcttattgcttattgctaaagcgcaacctagccccaagggttgcgttttttattatggttttttgaaaacatttacctagcatttgaatacgataacaaaataaatttaacttaaaaatgtacatattgttaacaatattaacaaacagcaaagaaactgcatgaaaaaagtcatctaaatattactgatggtttttttgatgcagtttttatatgattataattattttattccttaaaaaatctagaatgtaaaacattctagattccatctctatagtaccccattaccttcggaacatagttctgagtttcttgtggcattttatataagtcagaagctgatgatacacctcttctttgcatagttccaggtcctccattgtatgccataagagccaactctgaacttccattgtatttatctaaatattctttaagcaacttagttccaccgttaacattttgctcaacatcatatccatcagttatacctaaatgtgaaaaattttctggcattatctgcattaatccagcagctccgacaccagatgttgaattaggatcaaaatcagactcctgcttaattacagctaatattagattaggatctactccatattttttagccgcatcatctacagccgaatatattttcttaatatcagctccacttttattagataatgcagattcagaatttcttgtaaaacctatataattattagttaaaaccattggtatttcctctaagttttgtcctgttacatatgtttgtcctactctagctgcattatttaaatttatattctcctttgaatttaatttctcactgctggttgtttcaccttttacttcctttgtattcccatttgattcagcattaccattttctttagatttttttgatgattccaaaagatttttcataactagttgaaatgctaaatctttttcaccactcgtgctattgctagaatcagaatcatttgttacttgtccattgcttagcatattcattgctaataattgatcatttgacattttatctaaaccatctatcgccatacttaatcaacctttctccaaaatttatcctatgtttattttcgagttatccttttaaacctttaacataaaatgttacttcagcataatcctcataactaacttttttataataacttttggctaaagctaaaattttatatttcccttgagtaaacggcataaagctataataatgctttctactatatgcttgcacctttctccactcattattctccattaaataaaattcatagcaaacatttttcccgcctctgcttatagcttcaaatgtaagctcctcatttatatggccctctagtgtatttgctattatattagtttctattacaggatatgcctcacttacatacaagtttatctgcttcttagaatcatactcactagtgcatttaacattcttagcataaacttctatagtgtatttaccagcagttttaggtataaatctcaactttttattttttgagaactctgttttctcaatagaatgtccattaattttagtttcatatttcaataaagtattctgcgtattttgaacaatgcattcaaattccacagcttccccaatcaaatgtgtttccttataaggcaatattatataatctatttcacccggtagatattctagcgccttcaaatatataactgtttgggcatcataagatttatctgagtacttatccttaagtcttatttctacttcatactctcctgcctggttaggaataaaattgatccagttagatttattataatctacaccctctaaccttcttccatcttttctaattgtgaatgcatattggagctttattccaccttcagcatttaccgttataccaacaggctccccgacaataatcttcttttctttatcaaccacaatatctaaaatctttactggcttttcactctttttctcaatattaaatgtaattctttttaaatcctcatattcacctttataagtaatatccttaacataaagtataatgtcatattctccagcttcagatggtttccatataaattcactcttttctataaagcccgtgtcctctttaatgggtccattaacctgatatctatatataactttgtttccaccttctatttctgaagtaaactttatactacttccacttatattaggagaattcgaatcagccacaaaattattaatcttaatcgttttatatggtttaacactatatactaaaatagctctatcatcatattctttatttgaaaatatgctttttacaagacataggattctgtagcttcctgcttctgtttccttataatacacgttatttttagttgaatagtcttgtatacaaattgattttccatctttatatattttataaaatttatatagtaatacaatatcttcattactaacaaattcttcaatatttgtttctactataaaaccaagcttttctcccgctattaatgagttatttaaacatttaaaattggttatttctactttatcaatttctctcacttttagtgtgataattctatggtcttcaaaagtttcagtggaatccattcttttgcactgaattaaaaattctttatttccagactcatttgctgtatattttaagatattacttttatcataatccttaattatatcccattcattattcttttttatatagtatctatataaatatacattctcatcatctgtctttatttcaatacaacatttttctccaacttttatttcctctttatctatacggatatcttttataaaactcggttctatttgatcattgttttcaattaatattttatttagaacttcttcattatattgagtattatctactatatcttcaacttctttggcatcattagaagatgatatttcttcatcagcatagctatttgatattaatacttctttttctgctctagaaatttctttaacttcaaggaacaccacattgtcttctatactattcattgcctctttaaattcaatattgcataaaataggatcttctttttcagacgctagcaaattactttctttatcattacaagcgcttttaatttcttcatcattagtaacatcttgaatactagtctctttatccacagtattactcacttcctctgtcactatagaatagtcctctttggctaaatagtctaaaggtttttttccatccctctctctggcttgtaccataaccatatactccccttctcttttaggcttccatatgcaataattttttcccgaaaattcttgtatagtattccaaaccccacctttgccaacaataaatttatattctaagttttctatttccccatctattttaccagatatatttatctccgtgccaactttttgcggtgtttgcttatcaaaagctatctcaacatactttaactgaagttcctccataaattcatactcctctcataccaattctcaaaatgatccttattattatattatacatttataccattttttgtaaataacttcagtttattttttatttgattatatcataaatgcctatataaactcatatattagtaaggttatttttttataaaaccttccagtcataattaaaataatatccaaaatataaatttataatttttatagcataaaaatagaagctcttatctaagcttctaaaattatcaactagttataagttttaataagtttttttccagtctaatattatcttcatcagttctttttttggggttagaggtctttcctccaccccttcttattttctgtgatatatgtctttcttccaataatctatctatgtttttctcatcatatatatatcccttagggtttattactttcgctttcttagatagacatattgcagccacaccatagtcttgagacacaattatgtcaccttctttagtttcattcattacatacatatctacactttgaaatccaccatcaacaactttaactacagaataattactctgtataaaatgatgaatatcgcaataaattatcactgaaatattgtgttcttttgccgctttttcaataatggagatgcctggacaggcatctccatcaataataatcttcataattaaactaaagtctcttttctagttcagccttcatatcttcatatcctggctttcctagtaaagcaaacatattctttttataagcttcaacacctggttgattaaatggatttattgctaaaagatatccacttattccacaagccttttcaaagaaataaaccatatatccaaaataatatgctgaaatttctggtacatttaatatcatattaggaactcccccgtcattgtgagctaataaagttccttcaaatgctttcttattaacgaaatccatagtctttccagccaagaaatttaatccgtctaaatcattgtcagcttcttctatgtttatttcatattttggtttttcaatatttacaactgtttcaaacattattcttcttccatcttggatatattgacccattgagtgaagatctgttgaaaaatctactgctgctgggaataatcctttatggtctttaccttctgattctccgtatagttgtttccaccattcgttaaaataatgaagtgatggttcgtaatttactaatacttcaattgatgctcctttattatataaagcgtttctagctgctgcatatttataagcatcattttctttaattgatggtactgaataagctgttcttgcgtctgcagcacctttcatcatttcatcaatatcgattccagccgcagctattggcaataatccaactgctgttaatactgtaaatcttcctccaacatcatctggaactacaaaagtttcatatccttctgaatcagctaatgtctttaaagcacctctagctttatcagttgttgcatatattctctttcttgcttcttctactccatatttcttttctaaatatgattttaaaattctaaatgcaattgctggttctgtagttgtacctgattttgaaattacatttaaacttacatcttttccttcaattacttgtagaagttctgccatatatgttgaacttatattatttcctgcaaaaaatatttgtggaacttttctcttatcacttcctaatacattatggaaattatttgtcaacatttcaattgctgctctagctccaagatatgatccacctattccaataactattaaaacatcagaatctgatttaatcttttctgctgcctttttaattcttgcaaattcttctttatcataatttacaggaaggtctacccaacctaagaaatcattacccgctcctgttttattgtgtaaatcttcatgaacagctttaaccatgctttccatattttcaagttctgcttcttctaaataaggagaaacttttgataagtctagtgatatacctttattcattcttctatcctacctccatatataactaaaaataattttattattcaattatatcataaattctcaatatctcatctttgcttttaacttttttacaaataatatatcaaataataaccttaaattaatcttatttaatctttactcggttctattttttctaattgtatgaattaatattcatcttatccttattggtatcaacttatttttaatacttaccataatacattgtttattaaatatcaatcatttttaaaattttaaaagagaaaactaagttttctctttataaaatataaattatatatttttcaattattaaaatccagataactttgttaattttttaactttattctgtgctaattggccaaataattaaatttattctatactaatatctttttttatttaacctcttgtttttcccccagcaatattgtaagtaactccatgaatataacttgctctatcactagctaaatagcaaactaagtctgcaacttctgaaagcttgcctgatcttcctaatggagttgttgaagttttactatatcctgctcttaactcttctacagtaattcctctcgtataagctagcgctgtctcatattctaaagttctgagtcctgtagcttctagaattcctggcgcaactccgataactcttatacctaattttcctagctcctttgcccatgagcgggttaaagaatttactgcattcttacttgctgcatagacactttgcccctctgatccttccaatccgctttcagaagacatatttataataaccccttttccttgacttgccatctctctggcagctacttgagcacatagaaatacaccttttacatttacattcataactttatcccaaacattttcatctagctcaaattttccttttggttcttttttatcaactagtaatctaggaatattaatacctgcattatttacaattatatcaatggttccagtaatctctttagccttctcaatcattttttctacgctatctctatctgcaacattagtaactatatattccatatgtccattatgatcatcaaattcaggtttgtttggattcatatcacaaacaactacatttgcaccattatttaaaaactcttgagcaactgccttaccaataccagatgctccccctgttacaatcgctgtttttccttctaagttaagccatgtatttttcataaaaattcctcctgattatttaacttcattatttaatgccattttattattcatttcgatttcatataaattttagatataattatgctaatatagatagttcacttcctattttaagtttaggaatttcttttttctccacacaaattgttcctgataaagtaggtactttagaaccattaaacgcaacagttatatgtcctaaactcactagattcttctctgccacatctccaacagctgttatttcaaaagctattccatcaatcataaatacttgtccaggtttaattgtttctttaacttcctttatattaatagagtaacagtaatctgctagtgtatctggtgcattatctccaaaaaatattatcattccttcttctaagaatgtttctgctaaatctcctaagtcttttactttattttcatagattatcttactactcatagatgctttcatcccttcaaatatatttctttctaaaattattatttattctaagctacttagattatcggcaatttaacatggtattaccttgaccacataatatctcaaaatcttttttaaagttctctacagctacatccacgcaatcgtttttaattaaaccttctattacatcaggtgaaattgtagccgctccaattccatacttgcataattctaatacttgttgtgaattcttaaaactagctgctaatacttctgttttaaaattatttttctcaaaaatatcgtgaatgtcttttgccacttgaacaccatttgctcccaaattatcaattcggtttacatatggagcagcatattgagcacctgcttttccagctagatatgcttgcatttgagtatatatagcagtagcagtaacattaatttcttcttttctaagaatttttatagcctttaatccatctctagttacaggtatcttcacataagtatttttacctagctctttaataattttatgtgcttctttaagcataccttctgaactttcagaaatcacctgtacatgtaattccgagttttccccaataaattcacgtatttttattaatatttcatacggctgttttccatacttatgcaaaatactcggattactagttaccccatcaatttggaatatgctgaaaacatcttttattttttcaatatttacatcatcaataattagtttcactatggataaacctccttttattccactccttgcatctaaatcaacaatatattttccttggtgcaattgagcgattcataagaaccactcaatcgcaattaaataaatttcatagtttattgatacaatcctatacttgcaacccatgcaactgctactctaggtacaccaatcatgaaacgtgaatacaatacagatggaacaccaacctctactgtttctggttctgcttcagctagacctaaacctactggaataaagtcacatgcacattgtgtattaatagcgaataatgctggtaatgctaagcttggaggaatagtccctttacctatttcaacaccaattaaagtacctacgatttgtgctataacagcacctggtccaagtaatgctgataatagaggaatagagcatatgaatccaagaatcataagtccaattccgtttcctgctaatggtactaatattttagcgaaccaattaccaaatcccgaaccttgtataattcctattagcattgcaacaaatgccatgaatggtaatattgttgtaatcattgattgaactgcatcacggcctgcttggtatagtgtatttacaactttacctgctcccataccaattttttggacaatactagatttactgttttcagccaaactttgtgatactttcttatcagcactatatttaaattctctttttccttcttcaggcacttttgtgctctttataggctctgcacttgaatcagctaaagaaatttgatttaagccaactgcagatacataaatgtcttctgtaatgaattttgctaaaggcccacttttacctactggcataacatttattgtcggaattctcttttgtgggtatattccacagcgaagtgttccaccacaatcaataataactaagaaaatttgttcctctggtacagatgttttaaatccatttaccgctttacatcctgttaagttaacaatcttttctacaatttcaggttcagctccaccacctgtaatatataataatgtatcttttccttcttcaggttttactgtaagtggaccgccaaagcctccactaccttttacaattttaattgcattatatttttccatatgaataccctcctaaactaatttgccttaagttgattacttaattcaataccttgttgtctcataacaatctttgtagtaaaatcagttacccatcctgcaaagaaattcattactaaacctactaataaataacgaagtcctaaagctgttggatcaaggccaagagttgtaataccatttgcaatacctaggtaaatgaatatttcacctacattaatgtgaggaaaaataccgctgtttgtatgacaatgatacgatgctgatgcatagtagcttggtttcattctttcaggaagaaattttcccattgataatgccattggattacctaacataaaggctgataggaatggtaaaactccataagctaatataacatttctagatgcaaactttgcaaatctatcaactttatcttgtccaataaaagcaattattgaattcataaaaactaaaagtaataatacctttgggataattcccgttacccaactaacaaatgtatttccaccaacttcaaataaatacataaatccttttgcaaaataaacaattgcgtccatattaatatctcctttctaattgtgagcttttaattttttagctgtaaaaatattacctaatctttgtaatggactttgagattctacaacttcgccaccgcccataataacgttataattggaagaggcttctagtactgctttggttaatggtttagctaagttcttacaatctgcttgagttaatctaccaacatcttttccttcaaatccgtttagtttcttaacccttgcaagtactgttattccttgcatataaccgccttcaagtataattccattttgatcgatagcaaacattgcaatacatccagcacggaaaccacctttcactttgccaatggcaactcttcctcttcttcgcaatttactatagtaagccgtgaaacttttcatttgagcaaatgttagtatatattggagtataaatgcaattccaaagcatataatcaaaaaccaaaaattcatcataaacctcctacttataaatcaaatatatcgttttcttttgtaaaatgtagaattaattctttataactttttacctttgaaagagcttcaatggtattcttatcattggcaatagctataatttcatcataaattttaactaagagtgtatcatccttagtttgttctggaagtcctaccaagaatactagttttctttgattgttttctccagccttttctggaattattcctagactgactactatttcatcattttcataattgatagtatgaggaaatgctatagattcattaaaaaccatcgtagatttttcttctctttttcttattctttccttaaatccatcgtctacataaccttttgagtatagattatcaatcatatgatcaacattttctaaataactcaattgattatccaaaataaagaaggtatcttcatctaaaatacttagtaatatagaatccattccctgcatggatggcatgtctaatttatctatatacttaatactttttattcttttcttcagcgcttcttcatcaaatattttctctaaatatattacagtagctgttgtcttaaagttagcttggacagtagatagaaccaaattgtacttatctagtatttcgctagtaactgtgctatctgaatacaaatctataactgtgttcgcatcaaaaataccttttaattgactagcaaccaacctagctgtaactcttccagttccgcatataactgcaactttgtatattttacttttttctatttgctgttctgaaataaaaactccaaaatatgctgctataaatccaacttcatcttgcgtcatttttacatcaagacttttttcaataacatctcgcgctaactctgccattttgtacgctactttatattttttcctgatctcatctactataggattatgaatatggaccccatactttagacgatttaccaagaacgccatatggtatacaaagtctttcaatatatcatctagcgtaatatttaaacccatgtcatatttaatgcgctctaatatatgatttactaaatttgatacttcttctgtaatttcaacatgcggtgaaatcccttctatgttagtcggagtattcattcctataattggcaatgctaagaaaattctttctttaattggaatacttatagtaagccttttttcaactgcatctgatatagtatttaccaatgtaaattcccaacttcttaataattcaccatatttctcgcttaatgtattgattgtatgtccatttaaaaggcgatctaaagttacaactagggaatgtatgaaagattcaaatgtcgttgtatcgaactgatattgatccgttatctcttttactaaatcaataacatcttcatctaattcgtattctccataaatcatttcataaaggttctcaagtacaagaaaccttatatttaattctgtaccttttaaggctagtccattatttgttttccctataatttttaaatcgtagttattaagtatctctctcattttctttaaatcacttattactgtcgttcttccaacattcatctcacacgctaggtcatcagttaaatatggctcttcactattcataagcttatataaaataaatgccattcttctttgaggtgaattaagaaattctttttggttatatatattagtcttaatctcctcaaatttgctattatcaataatataaattttatatattccttgcttattatcaattagcgcagatccttttaataaactattcaactcttttacatcatttttaacggtttttgaactaacctcaaatttttcagcaatggcgtcaacagaaatagaatgtcttcgttcaattaattttaaaattcttgtcgaacggttttcagtataaaaatacttcatttttgcctccttgaaaagaatcaatacttattaattcatttaaattaaaataaaattattgctattaatcttactttaacttgttgttctttgattttagaagtctttaaaaattatactcatagtataatcttatgactatcttatattcaaaggttgattttttcaagcgttttcgatgccccctttctttaatgtaattatactttataaaatgataacgattaatgccgtctttttcctctacagagaaaatgtttgcacaattgtattcaattagtattaaaagtaactttttaattaactcttatctaatatgaactatttaaattatcactataaccatatttatattaaataaaaagggtgtttaacaatgatttttcaatcacttataaacaccttttttatataactacttattatataatttagttctgcttaacagcatctacaacatctatttcttctaatataatctaagacctcttgttttgctttttcatacccagcgcaatatccttgcttgtatccagctgtctctcctgctgtttctcctgcagtatttccatcctcatacccatcacgatatccatctttatagccatcattatatgcatcttccaacgcatcagctaaacagtcattatttgcgttagctccaagagttccattgccacaaggattacaatttctactatccatctctccacgttcttcttcacaattacaacgtctgcaatttctattatttctgttttccattatttcctctccttcgtaatcagcattaattttcgtttaatcattgctaaagcgcttagttaaagtattgctaacataaaatcattattgatttgcctataaaacttaataactatctaataatatattatgctgttgtactttatttgctattagttagagaaaatatgtatttactgctttaaaaagattactcagacaatctaacattaataatatatttataaggatttattctatgaaataataactattattaataatctctattcatattaataaataattaatactttatattatcaaattttccacttaacatacgaaaaaggcttagatactaaaaattcagtagtatctaagctttatcatcaaatttaatctaaattcttatcgatgttttgtttaacttatcggtttattcccattctatagtagctggtggttttgaagttatgtcataaacaattctgtttactcccttaacttcatttacaattcttctgcttactaaatctaaaatttcgtatggaattcttgcccattcagaagtcattgcatcacttgatgtaactgctcttaaagctattgtatgagaatatgttctttcatctcccataactccaacagaacggatattaggtaaacatgcaaagtattgccaaatagattcatcaagatttgcatttgcaatttcttctctgaaaatagcatctgcttctctaactatttcaagtttttcttctgtaatctcacctaaaactctaatggcaagacctggacctgggaaaggctgtctccaaaccaatttatgaggaatgccaagttcctctccaactgccctaacttcatctttaaataattctcttaatggttctataagttcaaattgcatatcttctggaagtccaccaacattatgatgggattttatagttgccgatgtcttagttccactttctacgatatctggataaattgttccttgaacaagataatcaatttgaccaacctttttagcttcttcttcaaaaactcttataaattcttcaccgattattttcctcttagtttcaggatcagatactcctgcaagttttccaaggaatctatctgcaacattaactctcttaatgttcatatcaaattctttcttaaacactctttcaacagtatcgccttcatcttttcttagtaaaccatggtcaacaaatatacaagttaagttgtgaccaatagccttatgtacaatcattgctgctactgaagagtcaactccaccagataaagcacataacactttcttatctccaactaattcttttatttcttttattttttcttctgcaaaagatcccatagaccagctgttttctaacccacaaatattgtgtataaagttttctagcattttttgcccaaattgagtgtgttcaacttctgcatggaattgaactccataaagccttttttcttcattttccatagctgcaacaggacaaacttctgtagttgctattaccttaaatccttttggagcttcttcaatataatcagtatgactcatccaagctataccatcagtttcgattccttcaaataatttagatgatttatctacttttacatttgtttttccatattctcttactggtgctgtcgcaacttttccacctagcaaatgtgccattagttgatcaccatagcatattccaagtactggcacgcctaattcaaatacttctttttctacagttggagtatcttccccataaacactgttaggaccgcctgtaaatattataccttttggatttttagcttttatcttttctatagtatagtcatatggaataatctcgcaataaacgccacattctcttactcttcttgctattagttggttatattgtccaccaaaatcaacaactaaaactaaatctcttttcatgttctcctcctaaactcttcttataaattctattatcaactaaataaatctttttatcaataaattgagacaattttcaccgaaaattataaatactaatttaaataatctctataattataaattaatcaaataatgcacagttcacataagtggtatattttatgattgtgaactgtgcattttactattgtcctacactataattaggtgcttccttagtaatgttaatatcatgtggatggctttctctttgacctgaagctgtctgaaccacaaaattagctgtttcatataaaatttcaaaattctttgctcctaaatatcccattcctgatttaattccacccaataattggaatatagtatctgagacaaagcctttataagctactctaccttcaacaccttctggtactaatttcttatttccttcttggaaatatctatctttagatccacattccatagcagctaaagatcccattcctctataaactttatagcttcttccttgatatatttccatttcccctggtgcttcttcacatcctgcaaataatgatcccatcattgctgcagaagctcctgctgctagtgctttcactatatcccctgaatacttaagtccaccatcagcaattataggaactccatacttcttacctacttctgcacaatccataactgcagttaattgagggactccaaccccagctactactctcgtagtacagattgatcccggtccaataccaaccttaacacaatctgctccagcctttattagatcctctgttgcttccgctgtagcaacattcccagctataacttgaagatcaggatatactttctttatttgtgaaacagcatctaaaactccttttgaatgtccatgtgctgtatcaagagttataacatcaacttgtgctttaactaatgcatcaactctttccatcatgtttccagttacacctactgctgctccacataataatctacccttcttatcctttgcagcatttggaaactttctaactttttcaatatctttcattgtaattaatccctttagacggccttcactatcaactaaaggtaacttttctactttatgcttttttaatatttcttttgcttcctctacagtagtattttctgaagcagttattaaattatcttttgtcatcacttctgaaatttttctttggtaatttgtttcaaatattatgtctctgtttgtaattattccaattaattttccatcttgagttgttattggaactcctgatattctgtattgtgccattaagttctctgcatcctgaataagatgatcttgagataaaaatataggatctgtaattactccattttcttgtctcttaactctatctacttcttttgcttgctcttcaatagtcatatttttatgtattattccgattccgccttctcttgcaacagcaattgccatcttcgactcagttacagtatccattcctgcactcattaaaggaatatttaattctatagtctttgttatttttgtttttgtgctcacttctcttggtaatatatccgatttattaggtaccaataatacatcatcaaaagtatatgcagtcttaattatttttcccattatagttcctcctatttttttgaattatttatttcattttcagtattttatgatttttcgcttgcattgcttgtactatttttttgtacaaaaaaagcacattaacctcaaaagtgatgttaatatgctaataaatctatagatttagcctatactaatatcacttatagtcggaaatttacggctcccggtagatactccttgccatattcaaggtatatataagttttcaaatgtgctatattttaaattaaaattattataatgtatgtacaatctaaagtcaataaatttgaagctaaaattgcaaatttacttcaataatgtaagttaaattttttgttatcgatatcttttctatttttttacatcatctttggtagatccattatcaatcgtcgtcggatttaaaatatctgtattttctgtgaaatcaaattctgcaccatttactacatcataacaatttttcaaacttgtgctactagtatttaaattaccaaattcaactccatctaaatacttactaatccctttgttgcttatagccgaacttacactagtgctttcacttagaggcgaatcatttttcaaattatatgattcaacggccattattacttttctgcactgatctacaactttaacttttttcgcttcatttatatagccatttactttaggtaaaatagcaacagctaaaataccaataattgcaattactgcaatcatttcaattaaagtaaaagcttctctctttctcttcttacagaatcttttctttgacatactatctttgaatctaaatttacatttaatgtataaagaaatcattattcattatccatctcctattaatatttttatttaaattatgtctaataggaaatcttttatacaataaatggaaaatattctctaataatttataatattgacttctagtatataaattttgtataaagttgcattgctatgattttcataagcttaaaggttaaacatataatataaaatactttttaaaattgcatagatatgttaatggctattaagcactttattttttaatactaaaaatcaaaatagagaaagtacttataagcactttctctatttattaaattaaatatttataactctttaatttatatattttagtacattccgtccattcccattcctggagcacctggcattggtgtttcctttgctggaatatcagcaactgctgcttctgttgttaagaatgttgaagcaactgaagctgcattttgaagtgctgatctagtaaccttagttgggtccactattccaccttttatcatgttgatatattctccatgtaatgcatcatatcctattcctggttcactattcttaactttttcaattatcactgaaccttctacacctgcattagtagctatttgtcttactggctcttctaatgatttaactattatattaataccaatttgtgtatcggcaacatctgaagttaattttgcaacttcgtttattacattaacataagcagttccaccaccagctactattccttcttcaacagcagcctttgttgcagctaatgcatcttctattctaagtttcttttcttttaattctgtttcagttgctgcaccaactttaattactgcaacacctccagctaatttagctaatctttcttgtagtttttctttatcaaattctgaagaagtttcttctatttgagctttaatttggttaattctttcttttattgcattagaatcacctttaccattaactataacagtgttttctttacttactttaacactatcagctgtacctagcatatcaatagtaacatcttttaattctctgcctaattcttcagcgattactgttccaccagttaatgttgcaatgtcttgtaacatttcttttcttctatctccaaatcctggtgccttaacagctacacaagtaaatgttcctcttaatttattaactactaatgtagccattgcttctccttcaatatcttcagcaatgattaataactttttacctgattgaactatttgttcaagtactggtaatatttcttgtatgttagaaattttcttatcagttattaatatatatggattttctaaaacagcttccattttttcagtatctgtagccatataaggtgatacgtatcctctatcgaattgcataccttctacaacatctaactctgttcccattgatttagattcttctatagtaataactccttcattaccaaccttctccatagcatctgctattaacttaccaacttcttcatcagcagctgagattgcagcaactctagctatatcttcttttccatctacctgcttagaaatcttttggatttcttcaacagctttatctacagccattttaatacctgttctaattagtattgggttagccccagctgtaacattctttagaccttctctaattattgcttgagcaagtaatgttgcagttgtagttccatctcctgctacatcattagtctttgttgcaacttctttaactaattgagcacccatgttttcatatggatcttctaattctatttctcttgcaattgaaacaccgtcatttgtaattaatggtgcaccaaattttttatctaaaacaacatttcttcccttaggtcctaaagtcactttaactgtatctgctaatttatctacacctatttgcatagatcttcttgcatcttccccaaattttaacatcttagccatttatatcacacgctccttatatatgttatttattatcgtttctaattgaatttgttttttatatttaaatatctagttatgaacactttaactattcaactattgctagaatatcatcttgctttaatatagtatattcttcgccatcaacctttacttctgttccagcatattttgaatataatactttatctccaacttttacttccatagctactctatttccgtctacaacagctccaggtcctactgcaaccacttctgcttcttgtggtctttcctttgcagtaccagttaagactattccactcttagtcttttcttctgcctctaattttttaattactactctttcaccaagtggtttaatgttcatgaaaaaaccctccttaaaatatatattatcatatcagtttattttctgttagcactcatcattgtcgagtgctaacataattataatatcctttatatccatataattcaaacattacttctaatattatatcccatttttcagcgaatattactccttatctcaaaatatatcgcatttacttaaattttctccatattattattaatattatgaatttttaaaataataaaaaaactctaaccaaataaacatattactgattagagtttttatgacattatattaaagaataaagctcttaaatttcataaataattttaaatcctaaatacctcattgctagagcacctatataataatagaatttttaattacttaattatatttcaaaatcaagatttatattatctttctaagtttatttcagtgtattcgcctaatgtcgtattagctaatacactcttagtacttgtttgctgatttaattttgtaaatggggctttagctttcattactgatacaattttagctgccccatttatacagccaccttcgcacatcattccttcaataaagtttccttgtaactttccaaccttagccattgtcatagtctttttaatttctgctccgcctgagatctttactggcttaaagtcaatattaacacctttttcttgtacatagttctctatagcagcagtcaatccaccacctacagcaaaatttctaccaaatattgaagctccatcaactactatatcttcacaagttgtaggatcaactccaaacgcatcgaataaggctactaattcttcaaaagttaatgcataatctatagcatcttttattgattctattagaacctcgctttttttagctgtgcaaggacctataaatatcacttttgcatctttatctttagattttatatatctacccgttgctaccatcggtgaaactgtccctgaaatcttattagcttgatctggcatcattttttcaatatagcttaggaatcctggacaacatgaatttgtcatgtagctatccccattttccattctctctacaaactcattactttcatgcacagtaactgcatctgctccacatgcagcttctaccatatctttaaagcctaatgccttaattgcattcttaacttgtccataagttgttttaggcccaaattgccctgttattgctggtgcaactacagcataaattttttcttctttatccatcaatctattaataactttaactaatgagcttttgtcttctatagctccaaatggacatgctgacatacatgcaccacagtttacacatttactttctgtaatttccgcactcaaatcttctgcattatagcttaatgcacctgttggacatgattttttacatggtctcatatcttctgcaacagcatcatacggacatgcttttttacacattccacattccttacatttatctggatctatataagctcttccatcaacatatgtaattgctccaaaattacacgcactttgacacttatgagctatacaatttctacatgcatcagtaacttgaaacttctttgttgggcatctatcacatgcttcttttataacatataatatttgtttttcttcttctatattaactaaatcttgtccatgtttgcctgttggtttaaatcctgctgcaagttttgctctctctaatactacatttctttctcgttcaactgaatctctatacttaggttcttctcctacaatcatagcataaggaattttttctatttcctctttactaatattattttcttttgctaatacagcaactctagtaagaacctcgtgttttaaagctagaagttgattctcaaactgaaacattacacacactctcccatgaataatttttatcttacatttataatacaaaataattatagcacactcttgttaaaattataacaaatattatataatttaaattttctaaattttcttaatatacgttctattttcatatgtatatagcgatatttctcaactactttagttaaagttttttcttgcatttccacttcttttcggatctgttcatttaccttatattagttatatcaagggatttatatgatatttatattattacatcaatgataaattattaacattatagaacatgttgttttgatatttttttgaccaaatgaaaagtctaggaactaaaatcctagacctttcattttataccaacctttttttaatctacatttatcttattttctcttgcataatagaataaatactgctgtgcaaaacctgctaatttaccaaacttggtccttccaaaaatcctaatcttatttagagatgcatcctctgccccataaaaatgaatcatcgcacgtttaacccatacatctaccgggaatgctgaagtcttttccattgaaaataacattatacagtcagctacctttgaaccgacacctttaaattcttgaagtgcattgtgacattcatcatcatctaaatttttaatataatctagatcatactttatacattcatttgcatcatttgctttcaggtcttcttttgctgttttagaattatatacattttttattgtatcaaaaatatatttacttctgaaagatgctcctgtctcctgtatttcttctagtgtagcatcttttatttcacctatattaggaaacgcatagtaggttttatccttataaataatttcttttccccatttattagatattttatttacagtcttctttattgatggtatattatttcgcgctgaaataataaagctaagcaacatttcaaatggatcttgattcaagactctaacaccatatccaaattcaatactttgtttaagtaaaacatcttttgaaagttcatcttttataactgagtaatctctatctaaatcaaaatacttaagccaaatatttttaaaatcttcctttgtagaattataaattattacgtcatttccatcttctttaacttcaattaatcttccaaacgcaattacaataaaatcattttctgctacctcttcaaacctaaaaatctgtccgcactcaaatatatgttttaatttaaaatttcttaattcttttattattaaataattatcataaaattctacagatttataatccattttattatccgtctcccttacagtataaaattatttagtttgcatcatctcataatctaatatgcatattgatgaaccctaccctttgattatgaatattcaaaatatatttttatctttttagtaaaatcattgataaacataatatcatatcaaccttagttttaacttatttcattcatatattcttctttaaataatatattctacactaaagtttttttctaaagattatgtcacagtttatattgcccattttctgatgtgtaccacctatatcatattttttaactatttatttttttaatatccaatattcaattaaattatacaattaatcttaagaaaatagttattatttaatatattatatcacttacttaacagtaataaaatgttttgttgaattttacaatattctttaatttaaacttatttatgtaatctagtagttatttatatatttccctaaaaataaaaaaacccaagcataaacttgagtttttccatatattcatgatattatttagagtaatcatagaatccttttcctgattttcttccaagccatccagctctaacatattttcttaatatgctgctagctctgtacttgttatcacctgtttcagtgaataaaacatccatgatagctaagcaaacgtctaatccaataagatctcctaaagctaaaggtcccattggatggttagcaccatatttcatagctgtatcaatatcttcaactgaagctattccttcttgtaggataaatgaagcttcgttaatcattgggattaatattctgtttacaacgaatcctggagcttctgcaacttctactggttcttttccaatagcaactgataattccttaacagcatcaaaagtttcttgagaagtagctattcctttaataatttcaacaagcttcattactggagctggattaaagaaatgcattccgataactttatcaggtctctttgtagctgaagcaacttcagtaattgataaagatgaagtgtttgaagctaaaatcgcttctggcttacaaattccatctaattcagcgaagatttccttcttaattttcatgttttcgattgcagcttcaactactaaatcacagtcagcagctaatttcatatcagttgttcctgaaattcttgaaagtatagcttctttatcttcttcagacatttttcctttagcaacttgcttttctaatcctttagtgattccagctattcctctgtcaacaaattcttcctttatgtctcttacaattacttcacaacctttttgagcgaatgcttgaacgataccagcacccattgttcctgctccaagtacaaaaatctttttcataaattattcctcctctaaatcttttcattatagatatccttagctaaaatatatattttaactaaggattaacttcataattatctaattgttacttattgaataatattgttaattaattatctttaatgttacattattaactttcaatagtacaatctaacaaaaacatatctaaattaaccgaataattattcagcgctctttatttctttaacttgagctattaattctggtactaccttagtaagatcaccaactattgcatagtcagcaattttcattattggagctgaatcatctttatttacagcaatgattaaatctgaatcttgcataccagcaacgtgttggatagctccagaaataccacaagctatatatatttgaggtctaacagtcttaccagtttgacctacttgatatgctccatcaatccatcctttttctacagctgctcttgatccagccacagttccgcctagagcttctgctaattctttaagtaattggaagttttctttgtttccaactcctctaccacctgatacgatgaaatctgcttcagctatatcaacgatatccttcttagcttttatagtttctaaaactttagttcttacatcgctatctgctaatttaacatcaactttttcaattttacatttagattgatcagttgtaatctttgcaaatactcctggtcttactgttgccatttgtggtctatgttctggacaagcaattgtagccattaggttaccaccaaatgctggtcttgtagctaaaagatcgccatttgtaacatcaacatcaattgatgtacagtctgctgttaatcctgttgataatctagcagctattcttggacctaaatctcttccgataaaagtagctcctacgaataatattcctggttttctttcatttgctaaatcacaaataacttttgtataagcatcagttgtatagtgttctaagtttttatcatcagcaactaaaacttcatctgcaccgtgctctgctaaagtttttgctaatccttctatgttgctacctaataataaagctgtaagatttactcctaattcatcagcaattcttctaccttcaccaagtagttctaaagatactttttgtaattcgccttctctttgttcagcaaagacccaaacgcctttgtaatctgctatattcataataaattaccctcctattatcttagatgtagtgtttttcttttaattttcctacaacatagtatgctgcatttttaggtgcttctcttacgatttctcctgcacctttaacttccttagtcattgacttcttaacctttgtaggtgagcctttaagccctaattcagctacatctacatctatatcagctgcgctcataactttgatttcatcatctgaagtttcgaatatatctacaacattcatatatctagtttcatttaattcttcgattgcagttaatagacatggagttttaacttctactacttgatgtccatcttctaatgctctatttactattaatgtatttccttcaactttaacgtcttgaacgtaagttacttgaggaatgtttaaatgctctgctatttctggtcctacttgtgcagtatctccatcaatcgcttgtcttccagcaaatactaaatcataatccaatttagctattactcctgcaagtgcctttgaagttgctagagtatctgctcctccaagtgctctatctgttaataggacagcttcatcagctcccatacataatgcttctcttaaaaccgctttagccattggaagtcccatacttattacagtaacttttcctccaactttttcttttaattgtaatgcaccttctaaagcgtgtttatcctctggattcattattgatggaacaccatctcttattaatgtaccagttttaggatcaatttttactgctgtagtatctggaacttgttttacacaaactactatattcattctaaaagtcctcctatcttaaaatgcttcctgcgataaccatcttttgaacttctgaagttccttcgtagatttcgcatattttagcatctctcatcattctttctactgggtattccttagtgtaaccatatccaccaaagatttgaactgctttagttgtaacttccattgcaacatctgccgcaaataatttagctcttgcagcatccactgagtaaggctcaccagcttgcttctttgttgcagctaggtatactaagtatttagcagcttggattttaacatccatttcagctatataccattgtaatccttggaatgctgataatggtttaccaaattgttttctttctttcatatagttaacagcttcttcaaaagctccttctgcaatacctaaagcttgagcagctataccaattcttcctccatcaagagttttcattgctataccaaatcccttaccttctttgctaagtaggttttcttttggtactatacagttttccataactaactcagtagttgaagatgctctgatccccatcttgttttctaattttcctattgagaatcctgggaatgacttttctactatgaatgcagaaattccttttgttccttgactcttatctgtcatagcaaatattatgaaagtttcagcaactccaccatttgttatgaagatttttgaaccatttaatacataatggtctccttctaatacagcagttgtttgttgtcctgcagcatctgtaccagcgcctggttctgttaatccgaaagcaccgattttcttaccactacaaagatctggcaaatattttgctctttgttcgttagttccattttcattaattactgatgcacataatgatgtatgcgctgaaagaataactcctgtagtaccacaaacttttgataattcttccacagatattatatatgaaagaacatctccgcctgctccaccaaattctttagaaaatgggatacccatcattttaagcttagccattttttcaacgttttccatagggaatctttctgattcgtcgatttcagcagctattggcttaacttcatttactgcgaattctctaaccatttgttgtactaattgttgttctctagttaattggaaattcattaaattaccctccttgttaattaaacctatttgatacaaactatatataaatctctaatagatttttaactaattattaaaaaattatttattttgaaaattcttttctgctcttctttctaagaacgcagtcattccttctgtttgatcttctgttgcaaagcactttccaaagtcttctgcttctattaatatagctgcatctatatcaacttgcattcctctgtctatagcatctttacaatatgcaactgcttttggagcattagctgcaatcttgttagccattgcttttgcttcttccatcaatttttctaattcaactactttattaactaaacctattctataagcttcttctgcatttataaggtcacaagtataaattaattctttagcttttcctggccctacaattctagctaatctttgagttccaccaaatcctggagttattccaagtcctgcttctggttgaccaaatttagctttaactgaagctattcttatgtcacatgacatagcaagttcacatccaccaccaagagcaaatcctgatatagctgcgataactggcttatccaatttttctaatcttctgaagacattgtttcctaaaataccaaattctttaccttgttcttcattaagatctttcatttctgaaatatctgctccagcaacaaaagatttctcaccagcacctgtaactataactgcatacacattgttgtctgcttctaaatcatctaaaacaacatttaaatcttttagtgtttctgaattcaatgcatttaatgcctttggtctattgattgtaacaatagctaaatgcccttctttttcaagaataacattttttaattccattctaaggacctccttcaaacttgcttatttttttaattttcacactatttttgatattttttatcctaattgttaataatataacaaataagtttaaaaaaatatcaagacttcacgcctcaattaaaattataatacgttcctagattatttgcaataaaatattgcgttattaatataagtttttaagtatatgaaaaaaataactgatcaaaggtatatatctattttcatgccaaacagagaagaaaactttattcatgtaaagcttttgcataagtttttcttaaatctatttctaaaaacaaatatatatatttaatctgttattttttgaacaagctttaaataatatattgcatatatttattatatttttaactttcactctcatttaataaataaattaaagtcaataaactttcacttagatgtacattttctactttcacatgatctggaactactaaatctacaggagcaaaattccaaattgctcttactccaccccttattaattcatcagcaacaacttgagcattttttctaggaacgcaaattataccaatatctattttatgttcttctagtacggattccatttcgtctatatccattatttctacatctctgattttcattcctattaatttaggatttgcatcaaatattgctgttattttaaatcctaaattttcaaatctagaataattcgaaactgcttgccctatatttccagcaccaaccagtgcagcttcataacctctgtctaatcccaatatagcgctaatttgggtatatagttccttaacattatatccataaccttgttgtccaaaatctccaaaacaatttaaatcttgtctaatttgtgatgcagtaaatccaatcttttctcctaattcttttgaagaaattctatccacctcatttttcataagttcttcaagatatctatgatacttaggcaaccttttgataactgccatcgatatatttttatgcttttccatatctactttctcctatttcaatacttttatatttttcgaccctataatatttatatcaaattaaattatataactactatttagacttttagtaattatgattagtctatttattaacaatcaattttaaaattatattcacattgttaaattttaattaattgctataatttataattctaccatatttctatatttttatgtcaagcttaattaaattatttattcaaaagtgcctataaatttaaaatttctcttgataagcaacagaagtctctagaaaactcactactatgaaaatttacttttttatattttgaccactttttttaatttaaaccgctttatttttaaccttttctatataataacaatatcaatacttaaacatgtgttcaagaactttattttaacattgtgatttttgtttatattaaataatatctttataaaattttataccttttaacaaaatcaaaaaaatatttcaaaataatttttcaaccattttgaaatatttcttatcttaagaaattaaattactttaattaccttattttcattgataaacacattgttcaatatcatatttaatacgctatcgcaaacataatacgaaaaggttaaatcattataataatttatagttccatcatattgcttctgtagctgcattataaactcttctatattacttgaatctacatgtgtatttataattcctgtcggatcaaacgacttagctaccttagctaaatttttctcatacatcatatgatgttttacagcgctcgtactcttaaattcccatctataatagtgtggtgcacagaaaaaatcacataaaaagtgacatattactccaagctcttcactaaacttaccaattgtcatatcatagtatatttcttccaatgataatgatgataaatgtataatcttttcaataatcatatttatactttcattaaaataatgcttcttaaatttatatttaggcgcacaatcaggtttcacgttcccccatataaatcttttattattaattaaataaatactctttgtattagcatattttataatattttctgccataatcttgtgagtattgatcatcaatgcttgatcacatcctctgcatattaaattttatattttatgaaaccctcatttaggcgtttcgttattttttataaattaaatttgttttgtatacttataataatactctagattcaaatttacaacactttattaatcgatttcttcaagtattatatgtactaatacccaagaatatcaaatctcataacgtattaaactatattagtaaaaatattagtttaatatagtttaagcatacatttcatatggtttctaagtgcatctccaaagataaataagctgcttcagtatcattaagatatattgaaacagcttacttactatagaaatttattatattctttattttcgttgagcctatttaataaatgttttatttcctgatccttatttttatccattacaagaataacatctccagcatctactacaactaagtcttttattccaaacccaattatcaggtttttgtccccaaatatggagcaattctcgcaatcgtcaatataaacattcttagatatactattatttctataagtgctcagtagcctacttaaagcgccaaaacttcccatatcatcccaactaaaatcacatttaatgacataggcttttctagttctttgcataactccaaagtctatagaaattccgtctataagttcatattggtcttttataacactctcttcattttcctctcctaaatttttatatatctccatcagtgatttatgcaatttaggcaagtatttttctatttctcttagtataacgtcggccctaaatataaacatcccagaattccataaataagttccttttaatatgaaatctttagctacctctgaatttggtttttctgtaaaccttgcaattctataagttggtatgcttccagcagttctttcccccatttctatatatccatatcctgtttcaggtctactaggttcaatcccaagtgtaacgatacaccttctcctatttgccatctctattgcttgtgataaagtatctatataattcttctcaccctgaatatagtgatctgatggtaatacaaccattactgcattagcatcttgttttaataattttactgcagacaaacctatacaagttgcagtttctttattagcaggctctacaaaaatattttcctctctaattcctattagttcatccttaactttttctttgtagtccatattggttacaatataaatattatccctgtctattaatggcattatcctatcaacagtattaactaagaaacttttatcgttaattagctttaaaaattgttttggttgatcggctcttgatagaggatatagtctactgcccttacctccagctaaaatcagcccgtatatcacgcattttcaactccatgtaatgatactagttcattatatgtcaaaatatttgtatgtgtgagtctatagtaaaaagaacaataaattatttcccttaaatgttcttcttcctgaattatagcccctccattgtgttcccttcaccaaccaagctatagaaatcttttgtaaatacatctactgcatttttagttgcatcatgttttattaatccttctattacatctggtgctgctgtaactgatccaattccatacttgcataaattcaaaacttgttgtgaatttttgaagcttgcagctaatacatccgaatttaatccatgcattttaaacatgtcatgaatatcttttgcaacttgaactccatcagctcccatattatcaatcctatttacataaggtgctgtatatcttgcccctgcttttgctgccatgaatgcttgcatcgaagtataaatagctgttgctgtaatatttacattttccttacttaataatttcatagcttttattccttcaggtgttacaggaattttaatataagtgtcctttccaagtacttcaatcatatgttgtgcttcatcaaccattttttcagcagttaatgatacaacttgagcatgtaattgtgccccttctggtaagaattctctaattgcttttaatacctccataggatttccaccttgtttttttagaatagatggattagttgtcaccccatcacatgggtaaaattcataaatccttttaatttcatctaagtttgcatcatcaattaacattaacattttttcttctccctctctctttttaatttctatgcttaaattaagtaaatgcgttataaatactataaaacaatactctattccaagaatatatattcttatattgtaatattctaaacaatatatattcttaagaattttagaattttagaattttaaaataaaaacatttttatttatacctttttattcagcaatcaatgaatatccgaaacaactacttaactaaatttcttattcctgctgaataagctatatcataaaattcctccatttgagtctcagtatacattttaggattctcttcaaaacaataatctaaattattgattaagttgtattttgattttgcaagtggattataatttaatagttcataccttacttttgagtaaatgcttgaaatatatccacttatatcatgaatattaattttatttgctgtaaattgaggtattaatggagttctgataatcacattatctttcttattgctttctaaaataaacttgatgttctttttgattagttcattacctacgccagtaaaaatcttatgcttatcattatcaaatacctttaaatctgcaaaaattgtatctagatacggtagcgcttccattatatattcagtagggacgaataaagatgtttcaatcgctgtatttattccagcttcttttaacattttaagtaatacaactacaaattctttctggtacaatggttctccaccagataaagttaccccaccaccgtatttaaaaaacgctttatccttcagtgctatttctataacttcatctaaagtataatttttagaatccatagttaacgcaccagtcggacaaatatctgtaacaatttcattttgttcatctatacatttatcttgaacaacacatattttattattttctcgtataactgattgattagagcattttttaatacatagatcacaattaatacatttattttcaaaatgaattaattgttcctttggagaaataccttcgggattttgacaccaaacacatttaagcggacatccttttaaaaaaatcgttgttcttattccctctccatcatgtgttgaaaatcttcttatatcaaaaatctttcctgttaaagacgaataatctttttccataggctatatatccccataacttgttcttgctataatttcattttgcaattctcctgcaagttcagtgaaatatgctgtatatcccgctacacgtacagttaaactacgataattttcaggatccttttgtgctgctaataaatcttctttacgtaaaacattaaattgaatatgtggtatttctaaatctacaaaggttcttaagaatcttgcaaacttatcccgtccaatctcatgcttaaaaaactcaggtaagaacttcatatttaataaaccaccattagtagttaatacattatctaattttgatacagactttaaaacagcagtaggtcctgcaatatctcttccatatacaggtgacataccaccgtcagctaaaggtgcctttgcatatcttccatctgcagatgctcctacattttcacccattggaacatgggcagatactgtatacattcctgtatgatatttacctccacgatagtttgtataagatttaagctttccattgaaatatcttgcccacttagcaccaatttcatctacccattgaatatcattcccgtatttaggtgcacgatttaatagcatagcccttatcacttcatatccttcaaagttattttgaagagcttttaacaattcttctttagaaattctcttttcatcatatactaaaagttttattgctgccaagctatccgctaaatttgcaacttgtatcatttgaattcctgacagattatatactgctccacctgcagtaacatctacacctttctcaatgcagtcgtcaataactgacgataagaatggcgaaggtaaaacatctatgtgggctttttcaacttgttcacaagctaaaatcattctatcaatgaaataatctatttgcttagcaaatgcttcctctaaatcttcatacttttcgtaagtggttagattacctaagtcttgagacaatgaatctcctgagattaagcattttccaccatttagagtgatctctaaaaccttatttaaattgaacattgctgcatcactccaaccaagattattaccttgagttgtaagctctacgcatccaacaattgcatagtctcttgcatctttttctttaattcctaagtctatcatagacggcactactgattcatcattaaagaactgcggcattccactgccttttgccacaacttttatgctctctttcaatagtttttctgatgtgttcttatgaagtctcacagataagttaggttgtggcagacctaaatgttcttgagcttttaggaataagaaagataattcatttgaaaaatcattactcttttcatcttggccaccaattgcaatattaaatcctataggaaatcctgcaaaaaatttagcactatgagaatttcttaaataaactatttcattaaacttaagccaaagacattcaattatttctaaagcctttttatcatctatatttccaagatgtatatctcttttataatatggatataaaaattcatccattcttcctggtgagaatgatgatgcatttgattccatatgaagtataacaaataaaaaccaaattgcttgcaccgcctcatggaaagtttgtgccggccttctagagatattcttacaaatctctgcaacttgaagcatatctgctactaattcttcctcgcagattgactcagctttttctttcattaagtcatggtatctcatcataaattcttgagcaccttccataacaataattacactttcataaaattccttactttcttttgtagaattcttcattttttcaatggctctttgcttaattccttctgggcctaaagcaagccactctctgcaatttggacaaatatgcccttgagcatggtctttttgatttatttttaccacttttgcaatttcatcaatttcttttccatatctctgtctaatgacatcctctaatgagtgtccatcccaatatggtttaatcacttttcgaaatgtttctatatcatttaaattcacattaaatttgtcttgaggtctagttggtagagattcaaattctttatcgatccatgagctaccgctctctggaaaaacaacaccatatctaacccctttagtacggttacctactattaactcttcatcatcaacaccaatttctaattttgaaagagaattttttaatgctaatgctctttttataataactggcttatcttcattctctttataagtttcagttattataagtgcttgttcgatagatgcatatcttttttcagataacatcttctgctttaaatttttaattctttgagacattattaattcatccatttctctttctcctttctgcttatttattatcatttattattactatgttcttattttatattattccaaattatttttcaatgtattttttattatttcatacagttttattaaaataatattgatttatttaaagaagattatttaatcttaaacacctaaaggttcaatttactaacttattctataaatcatagattttatattatatttattaaagttcatatatccctttcaaaacaaagggtaagagatcactcccttaccctttgttttttctattcttgttttagaatctttatataatcttttgcaaactgtgttgctacatcaatatctgcagaattttctccaatgtatatcctgtagcttactccattataatcccaaaccatataatatattttgttaacactaataggcttctttgtcacatcatcgccattttcacttctttcatatttagccctattttcttctaaaactctacattttatattatcaatagttgtttctttaacactattcatttctgaatcctcactaaattttgataagtatataaaaaatttatgtttctcactatcttcatatgattcacaaatgtttcttataatcttataatctttactaagctcattaaatatttgatcatctcctactgcttttctaaacttatctaatgagttttcttcatctttatatttcaaatctttaacagtcatcatcgctaccggagacacaggatatcctgcaatttccgtaatcgagaaattcccaacctcttcaggaaaatcaaattcaaatccaaatttcccctctatctcatttttgtttttatccgttgtctcaaaacctccaacggtaacatcatcaactgcctcatcttctgatttctcaataatattacctgatttatcaagtaaaaatattgtcttcaatgcttcctgcgcagcagcccttgctcctggtgaaaatgtaaaaacaccaataatagcaaataatacacagcatataggaactaatacctcctttcttatattttttatactaaaatactttttctttcccatttctttctccttattattccaagcctcattaaaaatatctcttgaagctttaatattaaaaatactatcatctatagcactctttattaccttatccaaataacccttatctttcatttttaattagactcctttctatttaactatgctcatcccactttccacctcaaagcaattggctaactgcttcttcaaagcagctctggcataaaacaaccgtgattttaccgtggccttaaaacaacctgtaacctttgaaatttcttccattgtcatgtcattgtaataataaagaataacaactgtttttaaattaggacttaatttgttgattgcactccgcattacatgttttatctcatatctatcaattatgttttctttttcttgattctcatcaaaaaataaaccttcattttctgatgttatttctaacggaactaactctgaccgcttttttgtcattttccagcctgttcgcataagaattttaaaaaaccatactttaaacgcttgtggctcttgaagtttatttatttccatgaagcatttcatatatgtctcttgaagtatgtcttcagcaattcctctatttcctgataaaaaatatgcagtagccaacgcctttttttctacaatttgaaaaagttcgcgaaatgcttccttctctccgagcttgcaacgcgttactatttcttctatatccatctttgcacctctcttccttttggagctcctataatataagaggattaatttagtaaaaaggttttattcattttaattttttcttttaatgagaactataatttataaatctcaatgacattttataattcttctgtattaatttattctttagctataaattaattatacataaaaaggtatattgttatgagtttgcttttttatgtataaaaataagctgtcccaaaatagaaattaaatttctattttaagacagctttgatttgtaaataaagctcagttaaattacttatatttataatttgctagtattcaaattaaatacttttttattctattcacatacctttcctggatttaatatgttcttaggatcaaaagctaatttaattccttgcattattccaatacattcacttggaagtgattcttttaaatatcccttctttgcaaatcctattccatgttctcctgacacctggccatctaattctttagctttattatacattatttgcataacttcttttaatttagattcccatgcttcttggtcaaggtcatctcttaatatatatatgtgaagatttccatcacctgcatgcccaaagctttttattcttatattagcagtacgttcaagttcatgagtgaaagttacaaactttcctatttgatttcttggaacaacaacatcaacttcatccatttcagtagttaatgctttaattgcttcaaggaaacaacctctagctgaccatattgattcttgtctttcttcagtatctgagattaatacatctaaagctccagcttctaaacaaatattagctacgttttcataatccttttcaatttcttctgtggaatttccatcgaaagttaataataggtatgcatcagatgatttatctggaaaactttttcctaaaaattcttctgcagcaagtatcgcttctctctgcataaattcgattgctgttggtattgacttagatttaattattttaggcacagtctctatcgctctttcgagactttcaaaaggaataagcaagcttaaagcctttttaggaagtggtaacaatttcaaaatagcctttgttactattcctaaagttccttctgaaccaacaattaaatcttttagtgcatatccagagctatttttaactacttttcctcctaaatttactatatcaccatttggtaatacaacctcaagtcctcttacatagtctctagtcactccatattttacagctctcatacctcctgcattagtacttatatttcctccaattgttgctgatttttcacctggatctggtggataaaataagtcaaattcttgaacatatttgcctatctccataagtaatactcccggttctaatgtaagagtaaggttttcttcatctaattctaaaattttattcattctgctaaggtctataactattccacctttaagtggaaccgctgctccaacaagtcctgttcctgatccccttggagtaacaggaatattattctcataggcatatttcattacttttgaaacttcatcagcacttatagtttgaataactatatcaggcattttcttaatcccgcctaattcatcatggctatagtcttcatttatttcttctctaaagaaaactctctccaaatcattctctgctatagataatatatattcataatcttttaattcaacttctttgtaactcatcacctatgcctccttagccatttttattttttctattaattctggaattatttcatacaagtttccaacaactccatagtgagcaaccttaaatattggtgctttatcatcagcatttatagcaaatatataatctgaattattcattccagctgtaaattgaactgctccagatattccacaagctataataagtcttggccttacagttctaccgcttaatccaatttgtctctttgcatcaacccagcctgcctctattagaggtctagtacatgcaaattctgctcctaaaagtttagctaattcttttactaattctaaatccttttctgatttaatccctcttcctgctgcaactattacttcagcatcacttattcctacttcagcatcttttttctttatactaagcgctgtaattttagataaaagtttttctttatctatagaacattctactatttctcctgaaatatcatcatttctttttggagctgtcataactttatatctaacagttgctaattgaggtctagaatttggagtaactatctgagccattatattaccaccaaatgccggtctaatttgaactaaatctgtattttccttcatatctaatattgtacaatctgctgtaagtccagttttaaatctagcagctattcttggcgctaaagatctacctatagttgtagcaccgactaaaatcgctgttggttttacattatttataaaatctccgaaagcagctgtatatggttctattctaaaatactttaattcctcgtcatcatatacaaataccttatctacaccatagtgtaataattcttcagctttatgagaaatattacttccgataaatacagcatatactggatgatttatctttcctgctaattctcttgcctttcctattagctcataagtaacaggatgtatttctccatctacatgatcaacataaacgcctattccattccaaatacttttatctatctctttgacttcttcctctatatattcaacagctcccttaggcccctttttaacgcaaagcttgcacattttacatgctccacttatttcaacaactccattattattttcaagggcaccaaaaggacatattttaattaactcatcaatatctaatattttctcttgatttactactaactttgccataacgcattctcccctttaattatctttgtgagatatctttactaatatttaatacctaaataaatttcaattcctttaatttctctcccatttttccacttaattcaccagaactgcctgtccacatttctctatcattattaacctctggtggaaatattctctctacttgagttggtgatccattaagtccataattcttctcatctttatcatcaaaatcttttaggcttaatatttttatttctctgtccttagttgaaagtttttttctataagaaggtaaccttggttcaaaaattcctttatctacagtgattagacatgggtacgctatctttactgtttcaatactttctggcatatccatttcaactgtgattgttgagtcttctactttaactatgtccttaacgttagctacatgtggtatgtttaaccattcagccatttcagatcctacctgcgctgtatctccatctgttgtttgcttaccgcaaataataagttcgaaatcccccatctttttcacgccttgagctattgtatacgatgtagctaaaacatcagctcctccaaatttcctgtctgataataatgtgccttcatcagctcccattgtgtaagcttccttaattacgcttaaagcttgattaggtcccatacttaagactttaacagttcctccttcactctccctaatcttaagagctgtttcaagagcatacaaatcatatggattcattttggagtctatgccatctcttttcaaaactcctgtaactggatcaacctcaactttagatgttcctggcacctgcttaatgcaaactaaaatattcatgataacttcctcctaaaactgtattttaaattccaaacactgattggcaaagtgatagtagtagttttgtcaaaacaatgtggaataaacaaacttttaaaaattacttcaatttatttctttgataaaatccaatatcagtttaattattccgctatatataatagtttttgctagagtcacaataaaactaatttattcctcctcttttccaacatgtcataccaatatcgaattggtatgaccaatttcaatttaattatactttccaaaatatagtttgtaaagtattgttatttatttaacagaaaatgtttacattgactctattccaatatactccttagtgcctcatattctatatctttttgcttatataaaatttattaaaaatttaatttatatttttaattaatcgtatttaagcattttttgtttaaaatataacaaaaataaaatggataaaaaaaataaccttactgacgattatcttttatccatcttatttttaaaacaatatatttttattttttatacccataggatcctcgaattaaatcaaagtgctctaccatagcattatgagctttactagcatctctgcatttcaaagctcttactaaattctcatgaatctctaataaattctccctagtttttcctgtatgtaaaatttgcgctcttgattttcgaatgaattcatccataagctgagatataacttcaagaacatttataagtaaagtatttcttgaggtttttgcaattaaataatggaacttaatatcaagttcaagactctcgtcctcattttctgctatatacattctatctaatattgctgttaaaagctctagctcattattttctatatttttagcggataacctagcacaacgaagctccagcgtttctcttaaatcatacatttcttcaattgaactttcttgtaacataaacatgacagaaagaggttcaaataatgaattatcaaaattagtttttatataatttcctgcgccttgcctgctttccacaagacctaccacttctaatgctctcaatgcctctcttatggatgcacgtgatactccaagagattctgacatttctctttctgatggcaatctatctcccttttttaatttaccactttttatgttgttcttaatttgttctataacttgatgatatactttaggtgttttgctattggatgtaaacatatatatctcccttgttcgctttattgtctaaaattttatattttattagtacattatacatcaaaaacagctagaatcctacatttgtagattttataattcattctattctatttataaacattcataatatatataatttatctatttgaaaatacttctctaaaatattatatttaaatactatccaatatatttaagtattttttctttattttgaataatcaaatcatacccattttgatatattgcttttagtttacttttatttcgctcaaatctacttatatccatacttatacttggtcttattataaatgctttcccactttcctctaattctttgcagtaatcaagttgctcattatatttaatatgcctattttttagcacatctgcaagctttggatacttatttttataaagcctataagttacttcattggctttagattttgtctttctatacccctcgttccttgttaatactattatatgtttgtcattaccatcctctattgacttattaattggtataggctctgaaaggcctccatcagcgtaatattgtccttctatcttttcaaatggaaatactaatggtatcgctatgcttgctctaagaattgaatttctcttatccaataaatctttatcaaagtactcattctttccagtctcaatattaaaagcacctgctaacatctttccatcaaattcataaaacgccttataatcaaatggacaatgcttattaggtatctcgtcaaatacaaattctaaatccataagagatttacatctaattaaatttctatagctgatatacctcttattatccataaatctttccattatctctaagtttcttcccctttgcctagagacataagaatatgcattagtggcacctgcagatactcctactatatattttatttctgcctttatatctaaaaatgcatctaacacacctgctgtaaataatcctctgaatgctccgccttcaagtacaagtcctatcataaaaaaacctccatacacaataaatactattatatattataacttaaataataaacttaatcacataaaaacttacatcaatggaatttctagttttttaatcaagtcgtttattcttagttgctatatcttaaatttcttaaatttataataaaaatgagaacctctataattttaacagcatagagattcccatgataaattgatatttatctatatttaattatttttatattaaagaacaaacttctcaatttgagatgtaatctgctgcattatatctttcaattcttctgctgatttagataccttatatgctgaattatccatttcattggctgatgcggatatctcctgagatgcggccgaattttcttccgatacagcagatgataattccacattttctactatattattttttctattattaatatcaactattgcatcatttatctcatgaacttgaggtactatatcacctatagattctactatttctttaaatgaaactatagttgatgctattgtacgaatctgctcctctaatttcttgttagcaatacctgttgtttcttcaactaatttagtttcggaacttatgtcacctagcaaattattaatatcttctgatgaacttttagattgctctgctaattttctaatttcatctgcaacaattgaaaatcccttacctgcttcacctgctcttgccgcttcaatagctgcatttaaggctaacaaattagtttcatctgctatttcattaatcatattagttatttctgttattttatttacacttaggcttaatttattaactttcctttgtgcttcattataagattctgcaatttcatttatcgatatacctatatttctcaatctttcatcactaatattggcttcattactaatattaatagtgcttttatccactttctctacagatcttgttattgaatctaatttatcactaaaagaacttaaattattgtttattgacataagtctttcagattgttcattagatccttctgctatatcatgaattgaactggatacatctcctatataatgcttcattttttctgaaacccttgaaagctctattgattgttctgtaacaaggctcgaatcttcctttactgtatatataattgatgcaatagatgttatggtcttgcttaatgcattctgcatcactccaaattcgtttgcggattcagtatcaaactttacagtgaaatttccttctgataagattgaaactttatgtacaaattctttaattgaattcttaatcatgaatattatatatgttgacataaacgctagagccagaattgatacgctcaatatacttataaacataaatatattttttctatatgcactcatagatttattaatctcatttgtagctttatccttttgaagttgaaccaatgccttattatcttgagcaatttgatttccatatacccccatagcatcatttgtaatctttttatctggagttaaatcttgttttctttgatcaataatatcaggtatgtacgaataatattgttcatattcttctttaaatttcataactaattggtgttcttctgaattattttctgattctttagcctgcctattcactatttctgttatatttgtatttaattctagcattgttttttcatttgcttcatcaaatggcctatctattattttggttaaagtatttcttaaaacacccatacttccattaacatcaccccaatcactaagttttggaataacattattatacattgtcaagttggcatcatacattttagatgtatttaaataacccaaaactccaatagtaattgttgatatcaaagataaaattactattataattatactccttatgatttttacatcttttactttttttaatctcacttcaacgtccccctatggcttaaatatataattacatacataacataatattgttaacgtgtgcagttataattatacatattaaccaatatgataacaatagttataattttacatataccttaaacaataatttacttatttatatttttgtgaaatataaataatatatagtacgaaataactcttagtgtgttgactaaaactatataaaatgctataataattacataaaataaatcactacattaaaagggagtagttataaatataacatcaacaatcgcgactatattgttagtctggtgttatataccctaacaggtaacgagacttttaatataacttcaaatttttgaagttatattaaaagtcttttttgttgttaatttatccaatatctatcattagtaacaactcttcttcaattgggtataacaactgtatatttctggacgatgtaccacttgagggtatatgttcaactaaattcagtcagagttaaactctacctgaaaatgttcactttatagactttagctaattatatacttattaaattttttctttgaaaggaagatgccataatgaaaaaatatttttctaaaacagtagaagaatctcttaaaaccttcgatgtgactttaaaggggctgacgagcgaaaaagctaataaaatattagactctgtaggcgaaaacaccttaaatgaaaaaaagaaaaaaagcattttatctgtatttctagaacaatttaaggacttattagtaatcatattaattgctgctgctataatttcagctatgactggaaatatggaaagtacttttgtaattttagctgttatagctatgaatgctattttaggcactgttcaatacgttaaagctgaacaatctctagctagtctaaaagcgctatctgcgcctaatgctaaggttattcggaatggagtcaaaattgaaataccttctaaaactgtagttccaggagatattttgatactcgaagctggagacttagttgttgctgatggtagaattttagaaaacttctctctcaaagttaatgagagttcattaactggtgaatctgaaagtgtggacaaattctctgatgttattgataaagatgaagttgctttaggtgatcaaaaaaatatggttttctctagttcactagtcacttatggacgtgctactgttcttgtaacgaatactggtatgaatactgagcttggtaaaatagctacccttatggaagaaactcaagaaaaaagtaccccacttcaaatttccttggatgaattctctaagaagttggcctttgggataattggtatctgtgttattgtatttggattaagcatgtatagaggtattgatctattagattcattaatgtttgctgttgctcttgctgttgctgctattcctgaagcccttagctcaatagttacaattgtacttgccataggcacacaatcaatggctaaagagaatgctatcattaaaaagctaaaagctgttgaaggtcttggttgtgtatctgttatctgttctgataaaactggtacattaactcaaaataagatgactgttaaaaagatcttcgttgataacaacttaattgatagtactaaaatagatttcaaaaattttgattcaaatttccttttaactagttctatactatgtaacgattctacttcaaaagatggtgctgagataggagatccaactgaagttgccttagtaaacctaggtcataaatactctttaaatgaaattgaatgtagaaataattacccaaggcttaaagaaattccttttgattctgatagaaaacttatgagtactcttcataaaattgatggaaaatatataatggttactaaaggtgctcttgatgtattacttgatagagtaacttcaataaaaacttcaaatggagtagcaaacttcactaacaatgataagatcaatataaataatgttaatagagaattatcatctcaaggattaagagttttggcattcgcttatagagagcttaatgaaaataaagaactcactttagatgatgaatatgattatactttcctaggtttaatttcaatgattgacccacctagagaagaatctaaagcggctgttagtgattgtattaaagcttctatcaagccaattatgattactggagatcacaagattacagcttctgcaattgctaaagaaattggaatattgcaagaaggtgacttagctgtagaaggattagaacttgataaaatgtctgatgacgaacttaattcaaaattaaagcacatttccgtttacgcaagagtatctccagagcataaaataagaatagtaagagcatggcaaaacaaaggtaaaattgtagctatgactggggatggtgttaatgatgcacctgcactaaagcaagctgatattggtattgcaatgggtataacaggcactgaagtttcaaaagatgctgcttcaatgattttaacagacgataactttgctactattgttaaatcggtcactaatgggcgaaacatttatgctaatataaagaattcaataaaattcttgctttcaggtaatacttctggaattcttgcagtactatattcatcaatatttgcgcttcctgttccatttgctgcagtacacttattattcataaacttattaacagatagtttacctgctatagcgattggtatggaaaaatctaaaaaagatgttttaaaagataaacctagggatgctaaagaatctattttaactaaagattttataatagatatttcctgtcaaggtttgctgattggaatattcactatgatttcttaccatattggtttagctacaggaagccatgggcttgcaatgactatggcatttagtaccttatgtttagctagattattccatggatttaactgccgaggtaaaaaatctatctttgctcttggagtgttcaataataaattcagctggattgcctttatatcaggtgttgtacttgtaaatgcagttttacttataccagcacttcaaacattatttgaaataactccactcactactaatgaattaatgttagttcacttatttgctttcattccaactttaataatacaagctattaaggttgttagagattttattgaagaaaacaatgaaaagaatagaaacagagacgctaatgattcaactatgagagctgcataaaacacctttgagattatataattagattaacgaaagagctgtatcaagattatttgattgtcttgatatagctcttttatttttatttatcatttatcgtttttatttattgctgccattatatgattttatatacatatctttaatttcactcattaaaggatatcttggatttgcacctgtacattgatcatcaaaagcctgctcaaccatttcatccattgaagcatagaacttttcttctgaaactccaaattcttttatgctctttggaattccaactttggcctttaaatcatctattgctttaatcaataattcaactttctcttcttctgtatttcctcctagatttagataatcagctattctagcatatctccatcctgcatttgggtatttatattgtgggaaagccgcttgctttctaggcgcatctgttgcattaaacctaatcacttcatctattaataatgcatttgctattccgtgaggtacatggtggaatgcacctagcttatgagccattgagtggcatatacctaaaaatgcattagcaaaagccatccctgctacggaagatgcatgagccatcttttctctagctttaatatttgtagctcctccattatatgcatctggtaaatatttgaatgtcaatcttattgcttcaagcgctaatccgtttgtatactcagatgctaacactgaaacataagcctcaattgcatgaactaaagcatctataccagaggccgctgttaatcctttaggcatgctcatcataagttctgcatctattatagccatattaggagtcaatgcataatctgcaagtggatacttaactcctgtttgttgatctgttataactgcaaatggagttacttctgatccagttcctgctgatgttgggattgcaactaaaattgccttttctcccattggagggaattcatatactctctttctaatatccataaatctcattgccaagtcttcaaatctaacatctggatgctcatacattacccacataatttttgcagcatccataggcgatcctccacctatagctataataacatctggattaaaatctctcattgcatctgcacctaactttgcagcctttaatgttggatcaggttctacatctgagaatatcttatattcaatatgattttcacttaaaatatttgtaattttatgagtgtatcctagatcaaatagcaccctatcggttactataaacgcccttttcttcttcattgcatttaattcttctagcgcaactggaagacatccaaatttaaagtaaattttatccggaactctgaaccaaagcatattttctctcctctcagcaattcttttaacattgattaagtgcttaggtcctacattttccgatattgaattcccccccaagatccacagccaagagtcaatgatggtgctaacttaaagttatatatatccccgattgcaccctgagatgcaggcatatttattaaagttctagcggtcttcatggctactccgaacttctctattctgtctactgattccatttgatttgtataaagtattgatgtatgaccaaatccgcctaattctatcattctggaagctaatcttagcgcatcatcaaaagttttagctttatacatacctaatattggtgacaatttttcatgtgaaaatggttcttctaattcaggtgattcaacttcacctattaatactttaacagcttctgatatctctactccagccatttttgcaatcttgtaagctgactgaccaacaatctctgaatttaaagatccctttgaatctaatattatacttctgaccttatcaatttcttcacctctaagtatataagctcctctttcatctaattcctttagaacctcatcatatactgattccatagctattatgctctgttctgatgcacaaactaccccgttatcaaaagtcttagaaagcaaaatcgagtttacagccatttttatatgagctgtatcatcaattatagctggagtatttcctgctccaactccaatagctggttttcctgatgaatacgcagctctaaccattccaggaccacctgtagctagtataatatcagattctgccataacgtttctggataattctattgatggctcatctatccatccaattattccttttggtgcaccagctctttctgctgcttctagaactatttttgcggctgctattgttgaattctttgccctaggatgtggacttataattattccgttccttgtctttaatgcaatcaatgttttaaatatggctgttgatgttggatttgttgttggcacgattgcagctattacccctataggttcagcgatatgagttattccgaacatttcatctctctctataactccacaggtctttgtatctttatattggttatatatgtactcagctgcgaagtgattttttattaccttatcttctactattcccattccgctttcttctactgccattttagcaagagtaattctcgcatcgttcgctgccatggctgcttgcctaaatatttcatctacctcttcttgagaaaattttgcaaattctctttgggcttcccttatttgctctattctttttgtcaattcttctggattcgtaactctcattttctacctccaacattatcttctaaattttcatactcaagctgcttttgtatggcagttttacttactataaacaaactgtgtatagtttatcctgaaaataatatttaatttatcccatctcaaaaaaattgctaatgaatctaatgaaaatataaattatatattcatttgcaatgagaataaagtacatatcattctattattttccaaaaatcgtaaaataatagacatgatagaatagattattctttttcctattctacatgcctctaacaaaacttcttttatattgatattaatgtattgtagatgttaaatttaatcctatgactcctattattataagtcctataaaaactgtcttctgcagattaatcgattccttaaaaaatacaatcccgatagctgacagcaatattatcccaatgcctgaccaggttgcgtatgcaactccaatttgtactttctttaaagctaatgttaacatgcttaagcttaatatataaaaacctagcataacaattgcatattttatatttgtaaaaccttctgataacttcattgatatggttcctgaaacttcaaatattatggcaaaaattaaataaatccaacttatcataatacacctcactcaatagcatccgttaataaactttttataaagaataatggatatatcattaaatacaaattaaaaatccaccacaataaatcgaaatcatatctcatagtccagaaagaaatggcttgaagtcctgaacaaaaagttaatacaagcgaaatcagactaaattttttccataattcatttgtagtgtaatacatatacaaactaataaatcctgttaatgaaattaataaatcaagcggtaagaatgaccaattccatgatactaaaataggattttcgtaatctttaaatagcaagctctctggaatcagatggaataaggtaataaaccagtaaactataaaaccaatatctgtgactaaaaaaaactgctttaatattttcattttcacttctcctattttgatataagattctaaattcagattttaattttcttgcatattaattcaaacaatttaattaaattcatttaactaaatttctaaaaaaatttgttttttctattattctttactttttaatactttaacaaccttactaaaaagaatacttagctcctctaatttctcctccgacgtaatttcacttattaaattagcgaattgcttatagattgcattgtcgccttctattatctttatccccttcttcgtaacttttaaataataaattcttccatcttcttctgattttactttttcaactagttcattttttattaatctcttagccaatgcagatattgctggtttagtcagttttaatttttctgctatctctcctagatttggattttccatattatatattgttgtcaaataataatagtccgttatgttaaactgcttcttttcttcagttgataaaattaaattaatattattcatggactgctgccataaataatttgctatatattcaaaatgtttttcaatcaaaatattcatctcctaaaatagttcaattcatttaactaattctatgggtttatattaatttatttgtatacctgatgtcaagggatatattcaaaacatatgtttcaatgtgaatgtcatattttacacaaactactatgttgttatgttgttagattgtatagtatactaatatcagttagctattaatttcttttaacttaggaggaactatgaataaaattattgaaaaggctaaaattacacatgagttaaataaagacgaaatacttgaattactacaaagcgatgatataaatgaagaactatttaaagccgctgatgaagtacgtcaaaaatacttaggggagtatgttcatttaagagggcttatagaatttacaaatatctgcaaaagaaattgcctttattgtggtttacgtagagacaataaaaatcttgaaagatatagattaactgaagaagaaattctagactttgctaaaaaggctgttagctatggctacaaaacacttgtgcttcaaggtggagaagatgattattttactaaagaaagaatgacaaacatagtaaaagagataaagaaattaaatgtcgctttaaccttaagtttaggtgaaaaaacttatgaggaatataaagcatttaaagaagctggagctgatagatatttaataagaattgaaactactgataagaagctctatgaagatatggatcctaacatgagcttcgaggaaagattaaattgtttaaagaatttaagagacttaggatatgaagttggaagtggtattctagttggtctaccaaatcaaacattagaatctatagctagtgatatacttttctttaaagaaattaatgcagatatgattggtataggtccatttataccaaatgaagatacacctttaaaggatgctcaaggtggaaatcttactctagcattaaaggttatggctttaaccagattaatacttcctgatataaatattcctgcaacaaccgcaatggaatctttaactccaaacggaagaatagttgcacttcaaagcggtgctaatgttgtaatgcctaacgttactgaaggtgaatatagaaagctttatgcattatatccaggtaaaatatgtacaggcgatacacctgcacactgcagaggatgcataactggtaaggtaactggaataggcagaataatttcagatggttatggatttagaggaaatcaaaacactagtgcctataataattaaaaactattagtaacaataagttaaatcatagtattaagtagaatataccatacaggatagataatataatcctatatggtatatttttatgaattgctatgatttaacttctatttatattccttttatttaaatttgttctattatttattactatctattttaagtctataagttaaagttgatcatgagatgtcaattagcttattatttaatgacctatctaattaaaattattatctacttcttgcttcccgaatcccaatttttataataaacaaaatccttatcaaatagttttagaggaattttaaattcagggattccaaatacatatggcgctatatcatacagctggtagtatattactaggttatcgtctcttatataaaaactttgattttcactaatgcccttaaatacattacctgaatcaaaataattttctggattctcttttatttgattttctatttctttatttattatgtcagaataattatatccttcactgaataattcctttaaagttagcagcgcttctttcttcttatctattgtatatgaagtccttgttgtcataccatgagctccaccaagaaactcataatagtcattatataggctaagaatttgattattatcttctgaggttgtgtatcttgaataaatttcatatggaaatcttggggtttcttgtcccttttctccgaagtattctttcgccgttttttcggactcctcagctcttggcaaaatatcttgattaattacattatttatcaaatttattcttttttcatcatttccacctactaattgaggcatatttatgtctaattttaagtaatttagatttttagttatagatttatccacaattttaattttgctttcactttgcattttattagttataaacatttcctgtggacaagcagtggataacattgaacttactattaatagccctgttatattagctataatacccattttagcgcctccctgatttatgcattttgcgacataatatattttatatccacaaaaccaacatgtaaaattatgtatgttaacagctttataacattttatccacaagcgaatgtggataatgttagtaagttgtactatttttatattatgctacttttttcaataagttattccgctaaaactctataaaaataaattttttatataatatccttcaataataaatttacatttgcccccctggtaatctaagggctcaattaaggctgagatttagaattttaattagaatatatatcacaaatgacttatattaggtcttgtagtttttctttaagtttagggtataattataaaagaaaattatatttgttttaattacaaggaggtgaataataacaacatgttaaaaggaactttaccaccaaggaacatttcttacaaaagacttttcaaaaataaaacttccttaagtattttggtattcagcttattgtttgtaatgttttctatttacctaataacacacaatatatcttataaaaattctatagcttctaatcatggttctgataatacaagtattgatgaaaatcatgttggatctgaaaatatattaaaaaaagatccttccaatgtagacaaaagtacacttcaaaatgaaagatcttttaataattcaaatttaattactgacaatagaggagttcccgtattatattaccattcagtgagagaaccggctgagaatgaggttacaataactccagaaaatcttcggatacagcttgagtacataaaaaatcagggttatacaacattaactttagatgaactaaaaaactacttattaaacaattccccaattcctgagaagagcatagttatcacttttgatgatggctatatggataattactacaatgcttttccaattttgaaaaatctaaatatggtagcaacaatattttgtataacatcagatctagatggttcctattatttatcaaaagaggctataaaagaaatgtctgattacggaatagatatagaaagccatactgttagtcatcccaaacttaatcagcttccatatgataagcaattaaatgaattgaaggaatcaaaagaaactttggaatcaataacaggaaaaaaagttgaagctgttgcctatccatttggagattttaatgatgatagtgttatcgccgctaaaaattcaggctatacgttagcatttactactaagagaggactctccgatagagatgataatattcttaaacttgatagaatttatattagctcaaaatatgatataaatacttttaaggaagttttagcacaaactaaaaaataactcttaaataaagagttattttttttcttctttgctatcttcagttgagtatttgggtaacttttgttgatttcctgcattatttatagctataggtatattatgttcgtatataaatttatttgttttagtaagctctccatattttaaagcttgtccattaattgttattaatgttttcctacttaaatctaacatttcattatccaatgcgtattcaaatatctccgatatagcatcatcaacatccttgttcaaaacatcaatatttcctataagttcttttcctttatctgtaggagaataggcatatataactttgtgaaacttattaatatgaatctttatattggaagttgtttctatcactattatgctttgtgttgtcctatattcaatagttataccactaccaatcaatattaatataaatagtaatattgatatatgtattttgtaccccctaatccctttcttttcttttccttcacatacatctccaacctttgatctattaaaagtctttatctttaaaaattctccttttgaagttaatatatatgctgaatttttaaaagcttttattactatccctttatatagctgttgatttttacttgaaatgcttacaactttattatcttcttttaattttattcttagataatcttgaataaatttataatttgaattagttattataatgcaataagctattatgtagtccctaagtttatttataatctcagattttatcctagttaacttacttattttagctatcggtaaaactcttttttcattgattattcttagtaaatcctcatcactagctatataataagctatatttaaagctatatttctgtcagcttctttaatcggaaagtttactaaatctttaagtaaaacattatatgagcttaattcatttataaataaagatatctgtttttttctaatatcctctgcagtatctcctattaggaacattgacggcatagatgaaaatacatatttgtctttactaaagcccaaattttccataaaattaacacctctttaaaatattaaccctttgtataagttcttcatactatgatattatagcatataaagctatttatctataaaattttctttatctaaatttaatttaaaagcaatattttggagattattaatgagaggaaaaattatatatgtagattttgtaaaaagacgtagaacaacctttatacattttcatataaatagatttatttcttggtttaacattaaattttatattaaacccaaaacaagctctttgaacaacatgtcaacaaataaacgtagacgtattttaaattagtataattatttatataaaaagcctcataatatgttaaaatagtaaaataataaaacacataatgaggtgattatatgagaattggattaggatatgatgttcatagattagttgaaaatagaaaattaattttaggtggagtagaaattccatatgagaaggggctgctaggtcattccgatgcggatgttcttatccacgctataatagactctttattgggcgcttgtgctcttggcgatataggcaaacatttccctgatacagatagtagatttagtggaatatctagtatcatacttcttgaagaaacaggtaaattacttcttaagtccggctatgccataaacaacatagacgctacaataatagctcaaaaaccaaaaatgctgcctcatattgagaatatgagaaagaacatttcaattgctctgaatatagatattaataaaataaatattaaggctactactgaagaaggccttggctttactggtgagatgcttggaatttcttctcaaagtatctcttctgttgaaagtataatttaaaaatatactattcaaagtttatagtgctttataattaaaagggagctataattagcagattctaatctgctaattatagctccttaaattatatattaatcttttaaaatacttcgcttaatttttttagtagaatctctctgaatacttctcctttattaggatcacttattgcatttttgcagatatcttcccactcatcaatagacattcctattctattttctaattcttcttttgtatttgttaataacgaagatgaaattacaaattctccaagttcctctggagtcttgaaaatttttatatataaaaattctgtgttatcccccatccacttcttattaaactctgctgggaatttatctaatctagcttgagccttttcagatggaatattccataagctacttaagaaatcatagtctctcctcatattacttgcaacttctttgtctattttctttagtttttctccctcacgaatgatcttatcaacagttaaatgtggaatcctagtaattaatttttcttttccatatatccacttataaaaagcttcctgcaagaacgaatattgaagataaccaatcaaacactttctattagggaaatatccccatatattatttataccattattgtttccaaatataagggtatgaaaataaatacttctttctgttggtggtttctgcataaacatatgtcctcttattgtcttgttcctactgataacgttttcccaataattaaatgaattataaacttcccacactttactcaccttcccaactaatattttataaaatatattattaatagttatcttttgttctctaattatattataactcatttatctcataattgtttattcttggataaatttgtttaatatatacatattaatatattatccccattttattattttattacaaaattttagacttttattatagatattcaaattgatatttcttatttattactttataatattaaatgtcaagttatttacagttatcatattattatattaagaattctattatttttttaatttaaataaattttaacaattaatatatttttatatagggtagattctaaggaggattaaaaattgtctttatgtgaaatatgtaatgccgaagctgatatacatcatattgttcacagaagtgaaggtggctttgatatagaactaaattataaatatttatgtccttcccatcatagaggaaaatatggtccccaccaatccaaagaagttgattatagatataagttagatcttcaaaataaattatacgatatgctaaaaaaagattattattcttttaaggagctagcattagaattaaatataccaagaaacactcttaaaagaattacaagaaatttaaagctttataaagaaggttataaaaaatcagaagtaatattcaaaataatgggtgaaaaattttactctgaagaaatgattgtcaacttaactttagacaaattaattgaagacaattattaacttattatgttatataattaaatttatcttagtaaccatgtgtaaattaaaataacaaatatctaaaacaaatttttgttttagatatttgttattttaatttaatctttatattcttactggagcggaaaacggggctcgaacccgcaacgtccaccttgggaaggtgacactctaccattgagtcattcccgcttattgatgcagatgaagggagtcgaacccttacaccaaaaggcgctagatcctaagtctagtgcgtctgccaattccgccacatctgcctaccaatattatacatctattcaatatattaaatcaatattaaattttatacatttgttatgattttttagatatatttatataacaaactatgatatattatatcttcctaaatcatcctccggacattctccttcatctttttgcttaatatattctttaatttctgttatcttagagcatccccatccaaaatctttagttgatgtatctacttccaacttttccagcggagatacacttaaatcaacaaagtgttctgccagtgataaatccagatcacttgtcccacaattgctaaattccaagttaatttcttcctctggtgacattgatagttcctttaattcttcttccaaatcaagatctagatttctttcatattgataactatctattgagtcttcaaacttatttaataaattcgctttttctaacctcttattcttagtgtctaactctcctcccccactggaatatgattttttttcatattgattatttgcttttgaattttgttcagatatgtcggtatcttttgttaaatcctcttctttggttttaaattgattaactttttgaagcaaatcatctgctctatctagtaaaatatcagaactactgttaactttctctgcaagtcgtgcaagctgcactgatgaattagttacttgctccaaggaatttgatgtctctgttatttctcctgataactcatatacagtttcaacaattaaatctttgctgtgattaatattattaaacacactatctatattagatactttaggtgctatttctttaactagaagtgctatttctgaaaatgaacttgatgcattataaatcatttccttctgctcatgcaactcactctccatatttttagactcttctacaagtttatttattatatttataagtctatttattatcttataaatattctgtgcagactccttacttttgtctgaaagctttttcacttccaatgctattacgctaaatcctcgtcctgcatcgcctgcgctagctgcttcaatagctgcattaagtgctagaagatttatttgttcagatattccattgataatattcgtaatcccattaacatttttcatatcaccttgtatatactctatgctaattaaaaacttttcgaaactatcattaacacttataattccgccatttaattcttctatgtctttagttccttttaaagatttatcatttattattgcaatatcttcattaattgaatgaacattattcttaacttcagttatattttcaccaaagttttcaagcttagtgcttatctgtacaaagtcattactttgtttattagtattattagaaacctctcctatggatgctgatatttcctctgtaagaattgatagttcttctgcaatttgatttaacgatacagaaccttctctaactatatttgaatcctctcttactgcctctatcatctttcctactgactctttagcttggcttacacttaggcatatttcacttatttcatcattacccttagtatatttatcatcaactttagtataaaaatcacctttagcaatactatctacataatacttcgccccaagtaacctgtttacaactataattgtaaagcctattataatagttaatattagtagcgtcataataacagtcactataatatcaataaaagctaaactgtttaatgcacttagtagatctttttcttctactgtgattcctatggcaagacctgttttccctatcgggctatatgatatatatctttctttaccctcataagtatattttcctgttccagattgggtcccaattgtcatactttttcctatgttatttagatcttgtaaattttctttatcagaggtcatattggttatatttttattctcatttaccaagctctcatcttctgaaactataaaattaccattactatctacaattaataaatttcccgttttcaaaaaattagtttctttgtttaaagaagcaaaatctttgcaatcttttatcgaggtaataattcctataatactatttgaagaatccttgataggtactgaatatgatatgacttttttctttgtgactggatctatatatggattggttattgaattttcaccatttattgatttcataaaactttgtgttgtctttattgatttcttatttcctaaagtatctattgaatttccatctttatcacttatgctcatttctaattgtccaactgttttcaatgctggtttaagtatttgaattttttcttctatttgcacattcttatccgttattatcggattgcttgcaattacttcaaggttcctaatctcactttttatttgatcatctgctcgtgatgcagcagttttcgtcatctcttccattacatttaagttgctctcttttaatgacttacttgcaaatctatatcctattcccgacaaagctataaatgcaattaataacattggtattaggaacataataattttaactttaatacttttaatacttctattcatctttacctcctgaaaaaaatactaaatacaacctaatatacataaattttatttgattttaataaattctaggttaaagccttattataattttgttaaaatatccaatatattctgagattcttaatatcttttgtattttttttgttaattagttgacatctaaaaaccatgtgcttataattaagaatattaatataataaataaacacgttgatgaggacagtaagctaaaatcttatttttcagagagagaatatgttggtgcgattattcttatataaatttagactgaaaaccacctctgagtggccctaataaagcccgtaattatcacgttacgataaattcaagtgacctatttaactgatttttaaaaaggtttttaatgtttattttatttgacctattttaatcagtctgttctaggtaattagagtggaaccacggatattacttcgtctctatttttagagatgaggtttttttgtttgcaaaaatgtatgattttagtaataaattttcttaaagatattattattaaaatttaacaagtcacagaatcaaaatttttttaaatttgaaaggagttttaaaatgataaaagtaactttaaaagatggatcaattaaagaatttgaagccagtttatctatttatgaaattgccaaatcaattagcgaaggtttagctagaaatgcttgctgcggtatagttaatggaaaggttgaagaccttagaaaagaaataaatgaagatgttgaattaagcatatgtacatttgactctcaagaaggtaaagatgccctaagacatagcatatctcacgttttagcttatgccgtaaaaagattattccctgaaacaaagttagctataggaccttcaattgcaactggcttctactatgatttcgatagagaaagtgcattcactgctgcagacttagaaaaacttgaagcagaaatgcaaaaaataattaaggaaaatccagaaatatctagatttgagcttccaagaaatgaagctttagaattaatgaaggatgaaccttacaaagttgaattaataaacgatcttcctgaaaatgaaataatctcattctataaaatgggtgatttcacagacttatgtgctggtcctcatcttatgtcaataaaatcagttaaagcaattaaacttactagaagtgctggtgcttactggaaggggaatgaaaaaaataagatgcttacaagaatctatggtactgctttcttaaagaaatcagacttagatgctttcctagaagctttagaagaggctaaaaagagagatcacaataaacttggtagagaattaaaactatttacaactgatgaaaatgtaggtcaaggacttccattattaatgcctaaaggagcaaaaatagttcaacttcttcaaagatgggttgaagatgaggaagaaaaaagaggttatcttttaactaagactccacttatggctaaaagcgatttgtataagatttctggtcactgggatcattacaaagatggtatgtttgtattaggtgatgaagaaaaggacgatgaagtatttgctttaaggccaatgacttgcccattccaatatacaatttataatgctgaacaacacagttatagagatcttccactcagatacggtgaaacttctactttatttagaaatgaagcttcaggtgagatgcatggtcttataagagttagacaattcactttagctgatggtcatttagttgttacacctgagcaattagaagaagaatttaagggcgttcttgaattaattcaatatttaatgggaactttaggaattgctgaaaagataacttatagattctctaaatgggatccaaataatactgaaaaatatatcaatgatcctgatgcttggaataaaactcaagatacaatgagaaatatcctagatcacttaaatattaattatgttgaagctgatgatgaagctgctttctatggtccaaagcttgatttacaatttagaaatgttcatggtaaagaagatactttatttacagttcaaattgactttgctttagctgaaagattcgatatgagttatgtagataaagacggagaaaagaaacgtccttatataatccatagatcatcaattggatgttatgaaagaactttagctatgcttatagaagaatacgctggtgctttcccaacatggttatctccagttcaagccaaagtgttaccaatctctgataagtacaatgattatgctgaagcagttacaaaagccttaaagaataaaggtattagagttgaaactgattatagagctgaaaaaattggttataagattagagaagctagacttgaaagaactccttacattttagttgttggggaaaaggaagctgctaataatgaggtatctgtaagaagcagaaagaatgacgatgaaggcgctgttaaattagatgcgtttatcgagagaattgttaaagaaatagaaaataaagaactataaaatttatataaaaaatgaggatgcccttgaaaataaggcatcctcatttttttagtttacacaattttcttactgagcctagactcatgctctttctgcaaaataatataacacttagtaaatcataataatatatctacaattaaccttttagtaaccactttctatgtctatatacgcattcttcatagtcgttaactgcttctgtaagtcaataattttgcctcctatattatcaactagtgcatctttgcttctcagcatctccttatttttttgtatagattcattcactttttgaatttgatcttctaattctaagaaaactgaatattcctttttaaagtaaggcttttgctttgcttctttaattagcaacttttcagcttctagcatattggattcattaataaacttattcgcttgatccttccaaacctctatagaaaacatgcttttcaatgttccgattttattttttgattcattgatatgcttttccgctagcttctttttattgcacaaatcatcatagtaaaaatatgatggcaatagaactcttttttctgaattcataactagatttttaaattcattctcgtaacttccataccttctcaataatgagtcataggcttctgataattctttctggttaatttctaattctaatttttctctcattagtagtgctaagctactttccttttcctctttcttcatacagatatcgttatatttttgctgtttttgtttccataacttgaccaaatcattataaccttccagatttataaaatcattatctgagactaaacttacactcgttattaacatcactgctaatggtactaattcttcttgctgattttggcttacaactattgcatcgctagataaatataatagaaccataaaataggtattagaaaaatttttaattaaagaccttttctcaattaaattttcaatttgaaatataatactagacatatccttatatgaatcaatgctcgctaagtctgctatcatatatagaaatgtatatggttgagattttatagctgctttaatggccgactccgtcatgacatctaaatcgagtttttcatagtaaagccttttctctttattttctggtctttgtcttaattttgtgattatatcataaatcttttctataagctcttctgtaatatgtgtatttgaacctttattttttaatgctgatatagttctattcatataatattcatttattgcatctaattttcttgctcttgctttaaaatccttttttgtcactaaaacagcataagctttctctaccatgtaatccaatgtctgtacaaactttcttctattgtatatcttcccataaggcgcatttgacaaacttattaatttataatataaaattagctttatttcattatcattaatgttttttaaattctctaaatttctatttagtaattctaaaaacttatcttcattatatctacccaataattccttaggtttacttatcaaattaaaacttgaagtaatattattaatgattgtatatacgattttaagctcttttcctgatagtcttaaaaatccatcataaaatttttcatgcctaatttctcgttttatattttcatttactagttctttaaatattaacgcttttcttttatactccactatatttttattgtaaataattatattctcattaaatacagcatcttcaaagtttatttttatttgaatactgttctttttagcttctaattcttttcgtagctcattatcatatgaaaattctattgtttcaacaatatcattatattcttctgttaagtttaataaactttcatatgcgtgtcttaatgttcttaattcttcatccagtgatactttcatcctttttattgattcatcttcgtcatctaactcctcagtcgatattttcaattcttgattttgtatctcagccttcagaagctgcccctctttttctagaagaagttcttcattctcattaaacttaattttcatttcattaagctttttttcatatgttttataatccgtttccatattcaatacacatttattttgcatttctacttttctatttaatatatcttggatttcttctaaataagctttttcttcttttattagtattatgatgttatttatttcacttattcgctttggagaactatctacctcaagaatctttttcctaagattattgattaaattttctctttgagcaatatcgttattgatctttaaaagttctttcttcatatattctatagtactaggagcactaaaacttaaattctttatatctagcatcaaattttctttttctttcaaatagtaatatagaaccttttgagctatttttaaaatttctattggatgtttaggtatctttctatttctatctctttttgaaatgttctcatacccgttagccaatataatctctatattattataaatttcttctgaaaaagaaatattagactttaacttaataccatttagtaatgtaagtgcagaaacattcatatccattccactgtcctgcgctatatctcttaaaagcatttccattacttttctaacaataatctttgtaactattggataatactcgcataaaaattctgcttttatcagatgatcgtagtacttttctattttggttccttttaggtaaccaaaattactttcaatgtattccatatattccccctgtttattttaatccgccattacattattccaactttataaattctttttcagttataatgtaatctactggtacatcatgataacttgttggaactttatcaagtacttgaaaatcatatgctaatgctaatttggtaattctttttatattatctttgttaactttcttgaaatatctatcataaaaacctgctccataaccaactcttcccccacgcttgtcaaaagctacacctggaactataattaaatcaagttcgtttggatcaatatatggatcatttatagatggttctggtattccgtatgaactctccgacaaattatccagtgatttaatttctactgcatccataagtctagttttaatttcagtccttggaacataaattcttttattattatttaaagattcctttataaaatctcttgtatttatttcagtgtcaaacgatatataaacaaaaatattttttgccaatttatagtactcgctactataaactgtttctaatattctttcatccattttttctttttctgttacatctattttttttcgcttatctaaaatttcttttcttagtattttcttattaataaagctttccatacaaacaactcctataattatacttcatatcaatcatgaacttcatattgttctcaaattaataaatctatagatattttatctagctattcactttacttattattttaattttacttactaaagcatcttatgtctattctttatatatctaaaaatagtaacccttacatagtagtaaaattaattatgctttatattgtacttatctttattgattatacatatatcttttaatataatgaacataaaatatgtgataaataaagggagagtaatttatgaactacgatgttgaattaataagagaaaagagctataaaccgacattttggtctggtggaatggcgacagaattaataacatatccagtagattctgattatgcaagccggaacttcttatggagacttggtatagctaaaattgatataccagaatctacttttagcgatcttacaaatgtttcacgtaaatttatggttactgaaggcaaaataacccttgatcatgaaaataaatataggaaattactaaaagcctttgaacaagatagcttcatgggtgattggaaaacaaaaacttatggaaaagcctctgtttttaacttaatgacaagagagaattataatggtgaattagttcatttaaatattacgcctagaaaaaagtgtgtattcaaatatcaagttccattagataaggaacttatagccatttgtttttatgttgtaagtggtagctttaaatttactattaacaataaaattttcaaagctaatactaatgatttgctattacttaaatccttaaacctaagttctatacatgaatttttactctctagcaattcattagaaattactaatataatagcaagcgtaatttatagtcaataatactgaaatgcattaaaaaggcttcatctcaaattacttataatttgagataactcctttttttatttctcttttaaaatacatattataaactgaaatccttaattactaccttaggcttcttaaagactacctcctttgttatttcatagctatctttatctatagttattctataaatatcaggacaaccttcttctctccattttttcatatattttgcggtagcatctatatctgtataataattttcatcataataatctgagaattccaaataagataatatgcatctcttatctaatactaaattctctctacctacattcttacatattggaataaagaatcttaaaggtacttcatattgatatcgtcctttaatttcttttgattccataatagctcttttaaataaaatattttctttataatcgctatctatttttaatttaaatattatttttccacttttattcttttctaatttagctttaatcatatactcaccatctgtcttatttttatatacttcttttattttaacacggtaaatatgaactgtctaaattttcaaaaatactaacacaaaaaaggaaacacttaatttaaacttaaatataagcgtccccttaatgtatgtctaattgatttctatattaataattttcaacaaatacttcaaagtatgcttgtggatgtgaacatgcaggacatgcagctggtgcttctttgccttcatatataaatccgcaattgccacacttccaaagagttacttcatccttcttaaatactgttccatcttcaatatttttagctagttttttatatctagcctcatgtcgtgcttcaacttcacttatctttctataaactactgcaatttctggatatccttcctcttcagctgtttttgcaaaacttggataaaggtctgtccattcttcattttcgcctgaagctgctgcaagtaaatttttcaatgtactttcgtggaatgagactgggtaagatgcttgtatttctatctgctcgtcaacataatcatccttaagaaatttataaaacctttttgcatgttctttttcttgttctgctgtttctaagaatatgtttgcaatttgcacaaatccttcttttttagcaatactagaatagtaagtatatctagttctagcttggctttcccctgcaaatgatttcattaaatttactgctgttttgcttccttttaaactcttcataatcatacctccaatataccaattttctatataatgataccactaaataattaaattatctaggataatattaactttaattcattattattcctataaataaagaacaagttgaattagatttttacatcaaattcaacttgtaattctacctatgtcattctaaacttacttatttcttcatctaacttttccgccaataattgtagctcatccgcatattttgtgaatctatccataactgctgttatttcctctgttgatgcagttacttcttctgaagctgaagcagtttcctgtgatattagtgatatattctcaatttctaataccgcttttttctttttctcatcaacatcaataatagaagtctttatctcatcaaccttgcttatcatcgtttcaattgatctaaggatttcgctaaatatctcctgtgtctttcctactgctaaatcttgctctgtcactacactttctgtagatttaattgctttaaccgctgtatcagacttactctggatatttgtaataataactttgatttcttctgttgatgattttgattgttccgcgagttttcttatttcctctgctacaactgcaaaaccttttcctgcttcccctgctcgtgcagattctatacttgcatttagtgccagtaaattagtttgctctgttatttgcgagattgtttcagatatagtatttatctttctagtactttcatccatatctctaactatgctatcaacttcacctgtagctattttagttttctttgatttctctattagtgtatctatcatagataatcctttagcacctaattctttggtgcttgctgatagtttgtccatttcattagaatttacacttattttatctaatctattagacaaatcattcatttctgtaactccattttgagcattttgcgattgatttgttgccccttctgatacctcttctattgcttttgcaacctctcctatagatgcagttacttcctcagacatacttgcaagattcgatgacgtttccaaaactgtttttgatgatttagttacattgttcataagctctgaaatattctttagcatttcattaaatgaattagctaaatccataaattcatcttttgtagatgaagtaatagagacagttaaatctccacttgaggctttttcaaatacttcttttaatttcttaatattatgtgctattcctttacttaataataaagataaaactattgaaataaagcatataactactattataattaaagttgtagttaatattgaatttgtatcatttgacagctctttttcatctaacgtcgctactaatttccaacctgtaatattattagtttcatatactccaaacttctttgtattattaaaggtatacgttataaatcccttttcattagtcttagcatcattccaaaaagattgtttagatgctgcatcagttcctaataaatctttattgggatgcgctatcatacttttaccttctacatcagaaataaaaacatatcctgttcttcctatctttttcatgcttattttttctgtaagtgtctctaaagaaacattcatagcgcaaactcctatgactttcccatctctttccactgtctttgcaatagacacaacatttttccctgtctgagcatctgtaaacggtaacgttattattacttttcctttattatctacagcttgcttataccaaggcctttctcttggatcaaatccttctggcattttactactaggatatatatcaaatttcccatcagtagttgcaaaatatgaactaaaaatgttactattactttcttttaaattctttagactttctggtatgtatgctgcttgctcactcttatcactgttaacaaagttataatctgtggatgtcatagttatcatattactgaatccatcaaaatagctgctaattccatcattcacttctaaaagcgtttgctggcttgttaattttagtttttcattaaggatggatttagcctgtatattggcaccataacctaatattattaggggaatcacacaaattcctattaagctaataactagtttgctgcgaatagtgttaaccctaaactttttcgttttcattactattaccccttttcataaaattgaacaaataacaatttaacttaatcaaatctgttatctatttgcattattttcccttttaatttttacaataacaatttacatattctttttattatcgcactgatagttcaatttctttacatatatactataatattattaacttttagcataaaatcgagtcgaaaattatactatttttaccatatgaatcttcattaattacatctaccttacttactaatacttgattgtacttgtacatatttaatataatatgtatatatttaatatacatttataatagtagagtgtgtggaggaaattaccttggataattcattcatatcagatatgagtatttttaataatgacatatcattcttaataaaacttagagcaaagccacaaatcttagaaatagttaaaaaaaagcatttagatgaaatttccgatgagatatctatacaggataagaaaaacgatttgcttatttggaatgctatgtatactagagaaatagttgaaaatggcattttaacgagatatcttcatccaatatacaacaaattctatactttaatccctaccctcaatactatagacgatttacaaactattgaaatacaaatgatagatacatacattaatctccttataaatgacgttgaagtgaaagataactttgtcataaatagaattctgaagcacttacatcttaatattgaaagccaaatctcattaaaaaaattatctggagaattaaatctatctgaaggctatatatcagattgctttaaaaaacatatgggcatgactattatgaaatatgcaaaaaaaataagaattgatagggctaaagtattgcttgtaactacaactagtagcattttagaaataggcttaaccttaggttttcatgatcaaagccatttccataaagtatttaaatcatttactggtgtttcaccttctgaatataggaacaataattttggataataaacaaacttttactttaataaaaagaagactaaaaacttgaactctcaaatttttagtctttcttatcagttaaatttgctgctaaccgggatcgataccacttaaactaaattattattctatttataaattatagcttccaaatatcttcattgtattgagcaattgtacgatctgaagagaaaaatcccgctttgctaatattcattaacacttttttgttccaagcttctctatcttcataatctttaaataccatatcttttgtgtttatataatcctcaacatcaagtaaagtcatgaaccaatccttattaactaattctttatgaagtcttgtaagattttcttcatccccaacttttatcatttcatcacttatgataaagtcaaccaattcttttatttctggctttttatagaattcattagaaacataatctgcattcttataatgctcgataactttttcagaagattcaccaaatatatagatattttcagctccaactaattcgtgaatttcaacgttagctccatcttcagttcctagagttaatgcaccatttagcataaacttcatgttaccagtacctgatgcttccttagatgcaagcgagatttgttctgaaacatcacaagcaggtattaacttagaagccttagtcacattatagttttcaaccataataacttttagatatttattaacttctggatcattattaattatttcttgtagacaaagaatagtatgaattatatcttgtgcaattacataagctggtgcagccttagctccaaatatcattgttataggtgtagttggcctattccccttctttatatccagatatttataaataatataaagtacattcatttgttgtctcttgtactcatgaagtcttttaatttgaatatcgaagatagaattttcatcaatttctactccttgtgtttcttttaaatattcctttaatgcaatcttattttcttttttaatttctccaatcttacttaacactattttatcatttatgaacttagctaattcttctagcttagcagcatctttcttatatccatctccgataagttctgaaatatagctggcaagtttgttattacaatgaattaaccatcttctgaaggttatgccattagttttattattgaatttttctggatatatatcatagaatggctttaactcttcttcttttaagatatcagtatggagagcagcaacaccatttacactatatccatagtgaatatccatatgagccatgtgcactctcatatctttatctataatagctactttttcatctttaaatttaagtttaacctgattgtccaattctctaataattggtaataagtgtggaacaaccttttgcaaataagctataggccacttttccaaagcttctgctaatattgtatggtttgtataagcacaagtcttagatactatttcaatggcttctgacataggtatacctctttctccaagcaggcttatcaattcaggaataaccatagatggatgcgtatcattgatttgaacaacaacatgttcatgtaatttatgaagatcatacccattttcatctgcttcaagtaatattaattgtgcagcattactaaccatgaaatattgttgatatattcttaataagcgtccagcctcatcactatcatcaggatataagaataatgttaagttcttcttaatatcttctttgtcaaaatcaattccttctttaactaaagtttcatctattgtatctacatcaaatagacgaagtttatttgatacttcttgatcatagccagttacatctatatcataaagagttgaaatgactgtgaatcctgcaaatggaacttcaaacttaatatcagatttattcaaccaactttcacttgttatccatggattcttaacagctttttgcttatgatcttcaaaaacttgtttaaataatccaaagtgatagtttagtcctacaccatctccattaaatcctaaagttgcaatagagtcgatgaagcaagctgctaatcttccaagtccaccatttcctagcgaaggttctaattcaatttcttcaatttcagctaactccttaccattcttagtcaaaacatctttaacatcttcataaatacccaaattaattaagttattcgatagtaatttgccaattaaaaattcagcagaaatataatataattttctcttccctctattaacactctttttcttgattgttccctttgttaattctaataatgctaaatagatttcttcattactcgcttctctcactatcttattaaaccttttctttaagatttcgtttaaatttttttctaacatataatttcccaccttaaataaattatttatttttatacccatgagtaatatcttcgatttagccttattatatcaatttacattcaaaccgattgtatatttctattatattttgtatatttatcatgtgaattttaggttcataaatttctataaaaataatttatgattagtcctcaaaaaaatagcctataggatagacttttataaaattatctatcctataggatcaaatttaaaatttatataattaatatttaaatatttataccttttatattggaattattaatttattatctgcataagttgttccttacatttaaaataagtatccatactttttttagatgaaaatatttgttcatagtttgcatactcattatagttgatattattatagaattcattttcctctacaattctaaaatccgagctatcattctttatagggaacttacctaaaaatgggttcttatatatgtatgaatttttctctttatctgtgtaaacatgatctgcaatattagaaaaatcgtttatacagaaaacatactcttcatcatttttaattaaattgtaacctaacatagattcaagacgtttggaatgattttcacctatttctatagatacaggttcataaatataaatactttctttattaatattccccttgataactttggtgattttaatctgagttaaaaccgcactatttaaaatttcatgtttacctgttgcaactccttctactatataatctgaaaaattactcatatcaatattattttcatcgcttatatctgtgaatacaccacctgaatatcttaaatctttatatggataatatgaatattgattcttttctgagagaaatttattataatcataattgatgatagatgatcttaatattaatgatgatattatgcctatacatattattagaaatataataagataaaataaatttttttctgatttaaatttcatatactctaccaagatcaactttaaacttcttatcaactaacctatcaatgtcctcactaatatgactagctattaaaatagttgctcctctgctcctttcttctcttaatatatttctcactctgattgccgactcttcgtccagagaattagtaggttcatctaatataataagatcttgagattccataaatgcttgtactaaagctaatttttgtttcattcctaatgaatattttctaaattttcttttatcttgtggatttaaccctattctttgcattgattccattatagctctatcatccactatattctttatacttgctatattcttcaaattatcaaatccagtttgatcattccaaaaccctgtattctcaatagttataccacatgattcagggaaatcaatttcttttccaatcactttgtcattaattgagacctcaccacttgttggtctaattaatcctgagatagttctaaatagcatagtcttccctgatccattactccctaggaatccataaatttttcctttttctaaagataaacttatactatctaaaattttagaatcttttactactttactaacattctttaattcaatgtaactcataactcctcctactaaccttcaaaattaaacatatctctttttttcttaattgatgtagatataatataaaaaatcaatgctataattaatgttttcctacatacttcataaataatgaaatcattagaaccgcaaggtattgaaaagcttgcagaaatattaagatattgattcaatagaaagttatcaattaagtttaatatggaatatattatgaaaggaattgttatagcaaactttaaattcaatgttttgaaatacactaatgtagcaaaaaaacctactgacatgaatgcagcagcttgagttattgtattaattgctaggtacatcttccaattgtcatattttataacagatgaatttaagactatatatatgactggtattacattcaatataagtgtaaaaattattgctaggaatatttggttctttattatagacaatctccatttctctatagtttgaaatctgattattatataatctttatcataataatctataagtatactcagcaatagtaagtatgctaacatgattgctcctattctgctgaaaaagcctaccccgatatcataaatatcgaaattactataatttgcagttgtacctattgaaaaattatatattaaaactgcaaatataaatagaaataaaaagattgatttaatatctaataacgctttctttaaatatatgctcataaactatatgctttcctttctttttataactaaataatttctttctttattcctatcacaaatgtaatcactgttagtaatatccaaatagataataccattaaaaattttttaaactcagctggccaagtttgaatatacatttgcatttgataatcatcagacaaaaacatttcagtcccattaactattaaaaatgttataataaccattattattttatttattttaaatatcatcgataaattaaatgctattaatgaggatattgaacaaaataatgcggtaataataataataataaaattatataagtgcggaaatctatcataaatatcttgtaaaaaatactctgctttattattttgaattattaagtatgcaggttgtccattattgatgcctacatcaggtattgatatccatgttaatatttcattaaatccaagtataaaaaatatagaaacaaatgtaactgtaaatattgtaattgttttggctattatatatcttttcttacctgatctcattaaaaaaattgaatacatgttattctctctctgctctataaaagaatcactatacattaaggtacatattaacggagcaattaatacaaatgttaaaaatatagttcttatatcactagagctaattatcatactgtaatctgtcgtctttcccaattgtaatgaattgcgctgaaatgtttgtttaaataacattgcatatgataaaattgttaacccaaataaaatagaaaaacaatatttaaacttcttactatttaaacatctactaaattccatttttaattcattcttcatcttttctcctcccatttgattgtgaaaagagagcatttaagctctcttttcacaattaaattgtttttgtaagatttattattgatagtctagttctccatcagtaatataactagtattcttatgatcataatggtcacgaagttgcatatctattgaagaccctttttggattactgtcccatcaacaggatcaatgctccagttttgccaatatgcataggtatcaatctttttccaatctaaaataacatttttattcgcatccaatgcacgcatatcaacttttgttgtgttttgcatgctctttgctaaaattgctacctctttatcatcatgattttttacacgatatcccatatctgttgcttgttgatgtggttgaagtattgcatttgagctatttaatttcaaagttttgtagtgtgagctagctgctgctggtataatgctagcgcatagtaaagctcctagagtgattttagctattaagttttttttcatggttattctcccctttaattgtagattattttcaattacatattctcacaatattgtaattaattaaatagcattttctctaaacgtacagatttctacattaaatgtaaatttcaaagtattgaatttaaattctcgaaaatattctttttattctaaaaaacaaccgttttatgctaataacctataattattcttaataaaaatatgaataaaaccaaattgccaaatctaaatttaaatattttgtctcttactttattatatataacattgtttagattctaattttaattcgaattcttttaacctgatagaacttttttgaaatctataaattatcatatattatgcttcctatagttagtttcaaaaataaaataagcataaagattcagaattaaacctgatttcttcatgctatatattttttgaataaagccctatcagaatattttttaatacactgattaatatgttatttttttcaattcatcaaatttactaactataatatctatttcattacttaatttagaaaaattgtttctagattgctgaatactttttaacctattttttaatttttctatttcatcatttgcatcctccgtcaaacaatacatctttttcagtgtatcattcatacttaaaaccaattcttttgtgccaatagaaagctttttaacttcatctgccactaccgaaaatcctcttccagcatcacctgctcttgcagcctctattgatgcattaagtgctagcagattagttctagatgcgacattatttatttcagatgatatattttctataaattttgtatgagctaaaagctcttcaaaagtttcaatgaagctattcacttcatctcctctgttagctacctcctctgagaaacttatatttcctctcacttcatttaataaattagatatagtttcaatacattcttttgcctgagtttctccattatttattaaatcgttattttcttgcattattatcttatcctccttaaagctcgcttattagatcttctaaaaaactatttataatacttagttcctctttatcatatttacttaatattttcacaaacttctcactctcaattttatgaagtatttcatgtactttaaaaacttctttgccttgtgctgtcagtgtataataaatttcttttttattattttctaagtgatttccttttatcaattctttctttagcaacttactagtaatcttagatatagcacctttcgtcatatttaattcttttgatataaatgttgcattaattaattgattttttccaatacaatcaattacgtgaatttccgaaagcattaaacccatatcataaagatccttatgattatattggattagcaaattttttatttcgtccccgtgactgtccattgaattatttatatgttcaaaaactgctacaagcttatttattgttaaatccatctcaaattttgcattttctttgttcataattacaatctccctttaaaattaatttctttggaaacaattatattataattgttattatgcatatattcaatattatttcaaaaaaatagtttacaaggaaataatattatgatattatgatgttgtttcccaggaaactatttaaatatattggaggttatcaaatgaaaattgatttaagttttaaaattaaaaaagaaatgttagatgaaatacacgctactactaaagccactaatgaagcagccgaaaaatctggacatataggaactcacctagatgtcatgaatggagaattttcaatcgataatattattacaaacggtaaaatatttgatataagccatataaagactggcgaagtgaaattagaagatttagatttaagtggcataaaagagaatgactttgtactcttttattcaggaatattaaagcagtatggatatggtacaaaagaatatttttcaacatacattgaattatctgatgagctagtagattatcttattgataagaaagtaagttttataggtgtagatatggcaggagctaaaaaacctaaagatcaccctcgtattgatttacattgtgcagaaaaaggaatttttattattgaaaatcttgttaacttagatttattattaaaagaagctcctaaaaaatcttttacagtatatacttttcctacaaacatgaatggtttttctggaatttcttgcagagtaattgctgatatataaacttatattaaatctctattaataaatagtatacgcatgcacgaaatttacttacatgaatttatgcatgcttaatatttatagaaattatgtcacagtcatatttcttccacttttataaaagttgttttttagcatttgccctactgtatatcatatcgttacaatatataaaatattgattcaacagtaacttgacaaaagcgtatggcagccatatactgttgtcatggataaatttataaataacaaacataaaattgcatatgattctctggatttagcatttgcattaattgatcttgataaaaagactcgctatttcggaactgatgtgccgatttttcactctgaaattcatataataaaggccattgctgaacatcctggtattcatgtgggtggattagcagatattctaggagtaacaaaaggttctgtttctgaaattctcaaaaagctagagagaaaggctctggttataaaggaaattgataatcttaatttatctagatattcgttgagtctgagtgaaaaaggtaaaaaagctcatagcagccatatgtactatcattctattttgaacagcatgtttgaagatgagctacaaaatgcctccgaatatgaattagaatttttgtcaaactttttatcgtctatgataaacaaagttaaatcttttaatgaaaactttgatgaataaatattttacgcaagtgtatagctgctatgttaattttcattataatttaagctagaaaatgctaatatcaaaaagagaaaattatcagaggtcagatatgacttctgataatagtaaaatatgtaagtgaatatataaacaattacccccaggcatatggcaaccatacaccctttatctataatcaaagcaagaaactcatattaactatgtgaactaccattctattgtgtcaaatatagttggatatgaaccacaaaatgtctccaaacgtgaattgaaatttttctcattcataataagcaaaattaagtttttcaattaaaattttatacatgtgtatgtatgctatacgctttttcatcacaattaagttaggaggaaataatatgaaaaagaaaaaattattaaagtcatttctgagttttgataatagtaaagtaagtaagagaaagcataaacctaaaacacttgatgctgatgaaagaggtttacggactgctgaaatgagtttatgggctatctatacttctttatcttcatgcgttctctttggtttttatccatatgaacgtccgatatttccaccaacgagtctttccaataacaaattggaaaacaataaatttgatgggctctaaaaaaataagataaatgaagaattgtaccaaagtgtataccaccaatacgctttaatctataattaatgcaaggaggatcagtgatgtatcaaaataggcgttattcccagaaaaaacttagtccttcaaaagaagaatatttaaaagccatatataagttatctgaaaaaacacaatcggtacgttcgattgaccttgctgcttatttaggattttcaaagccaagtattaataatgctgtggctatcttgcaagaggccggattagttgttaagcctttaggcggggaaatccagctcactgatgaaggacgtaaacaaggccaaataattacaactaagtttcagctaataaaacaattcttaattgcctattgcaatgttaatgagcaaacagcaagtgaagatgcctgcaaaatggagcatattatcagtgatgaagctacttttgctctaaaaaaatatttgaatcaagtataaacatatgataattttaaggagaaactatataaatgaatcaattacgtaatgaacacacacaaaacccacatccacattcaagaagatccatacaaataatactgataatcggaattacatttactgcagcgaatttgcgtgcacctttaacagcagttggcccgttgatcgatgaaattcgtagaagcttacatatttcaaatacattagcgggtatgatcacgacacttccgttattcgcttttgcaggattttcacctttcgctccaaatttggcgcgaaaatttggcactaagttagtgcttttttggtcacttatcttcctgactttgggaattatattacgttcgttgtttggagatttaggactgtttcttggtacagtaatcattggattatccatttctgtaggtaatgtgctgattcccagcttaataaaacatgaatttcctgagcggatcggtgtaatgacgggtatctatactgcttctatgggcctttttggcgctatagcatccggtatcagtgtcccagttgcttcagaatcaggattaggatggggagtagccttaagcatttgggcttcacttagtttcttatccattgtcctctggatacctcaaattatacgaagaaaacaaagactatctattgttcaaagaacggttcatagtggcattagaacaaaagccaaagacgtccacgaaaaaaaagatgaaatggagatcgttgaggcaaatagtattaataagatcaatctctggaaatctcctttagcatggcaagtgacagtatatatgggattgcagtctatgctactctattgcatggttgcgtggttaccagctattttagttcatcaaggtatggattcaagcaaagcaggatggatgctctccctttaccaactggtatctctccctacatcgtttgttggttctgtacttgctgggaataaggctaatcaacgtccattagttatcactgcttccctatgtgttttggtagggcttttggggatattcctcggagaaacagggcttacagcactatggatagttatattaggtattggcggagcgcttactttttgcttagctcttatatttttcagctctcgtacaagaaatgcagacgaggcagcaagactatccggtatggctcaatcaggaggctacttgctcgctgctttcgggccgatgctttttggttttctgcatgatgcggttaacaactggacattgccgcttattatcttaatcggtgctgccgggttatgcttattggccggtctaggcgcatcgcgcaatctttatgttagtaaaaatactgacaataaagccaccatctagaccttttatcttataatatagattaatgctgtaaactatttttaatttaaaaataacatccaaaaaggtggttttcatatgaaaaccaccttttttccactatagctagcaatcacattattatgacaactgattatatggcaaattctcttcctgcataatggtattatgtgaatatcttagacacaaaagttaaacttctaaaatgcattttattaaaccaaattttctccatctttaaatgctcttaaagataactcattaaaaacttcatcatcagttccacagtagtggatgcaatcctccaagttccaaccaaacacatcaaaaatattattaacatatttaatggcttctgcaccttttttcggatctaagcttccttgagcaaatacagttattaactttttacctggatgtctaggaataaacttatcaggaagctcttcaaccatcggaaacgtacgatctaaccaaatttttgcctgacctgtaatttgatacatatatattggagaaccaaatacaatagcatctgcctcatcaatagctttgtacattggctgtaaataatcattaacagcacatccatcatgagtacggcagtaaaaacaaccttgacatccacggattccagtatcatttaaatcaaattcaataacttcagcacccttggattttgctccttttgctacttgatctaataattttgtagcataccctttctttcttggactacccttaaaaataactacttttgacatttttcatctctcctaaatataaaaatttaaatcttatgttatttacatattcctaagtatcttttcaatccaactaaaaatacgttcattggcaattaatttagctccagcttggcaatggaattcagcaccttcttcagctgtaaataaaataaaatctttatagcaggtaatctcctcatacaattgccttgcttggtctctaagaagcttgtcattttccgaatcaacgattaaggtagggcactgtattttttctgctaatcctttcatataaaaatctccaacctttagaatgaattcagcaggggtatttacaccaaatacatacataccatgtgaaaagctccattttgcttttgagtttaattccactttttccttaacagctttattaaatccctctgaatcagaaagtgcgaaatttaaaaattcttctcttggcatattaaagatacttgtaaatcctcctaaaaagtcatatactcctccattagctatgcaacctgcaagtcgatgttcaaaagctgcagctctaggagcaagatacccgcctaaactttgtccccataatacaattttctttggatctacttcttttcttgtaagcagatagtctaccactggggttataaccttctcgtagtcatgtctgaaaaatagttgttgtttatgtacagcttctccttgtcctggtccttcaaaagcaatacaatgcataccgtgttcaagtgcatccattgccattccgcaaaatgcttcctttgttccatcaaagccagtcatagcaattaaaactggttttggttcctctgaatcctctaatttataaaaatgtcctgtaagtgttgtattttcataggggattttcacttcttcaataacaggcttattaagtttcatgacatgtgaaaagcaatctaagcttgcgttgtataactcatctatctttggattctctggattttcatgaaggtagaattctgcaattctataataattagaagctctaagataggcttttcttgcacttatcaagtgaccatccgaatagctatcttctgcaactttttgcaagcgcttggctgtttttgtccattcctcgcaccagctttgataatctccttctttaatcttttctgctgttgaaaccacctctcctatatctgcagctttgaaagaagtatctccaagaaggcctaataccttggatgcaaattgatcatctttaaaaatcaaattattcatagtaattctcctttacagtattcattgtttatgcaacacgttgttgctataattaaaatatatcatatacagatttgtattcaaccaacaatacttatagtttgttttatatacaacaaaggagtgaaaatgttgcaaaataaacatgatattcgaacaaaacgcacacatcagcagataagggatgcacttattgatcttatttttgaaaaacatttcgataacattacagttagtgacatcactaatagagccatgattaatcgttctaccttttataggtattatcaagataaatacgacgttgtactaaagatttttgaagacgcaatggaaagactgaagaaggatttaggtcctcctaaagaaagtcttaaaaatcttaatgaaaaccaaagatctgatccctgggtgaaactatttgatcactttgctgaaaacaagcgattatatctggcaatgctggatgattcatgtaacatatggtttatgtctagactgcgcagcaacataatctcaatgctaagagagcgtgaaaaattacgaagctcttttcttgtaagcgataaagactgttccccggagatacaagaaatggcattcttatttactgctaatgctttaatcggtaccattgattggtggttaaagtcaaactgtactcctgattcagagaagatgtcttatttatttagatcttattttaaaaatggccatataggaatgctgaataaagattaattttgtctgcttctcttactacttttattcctactccccttcccttaggagaaacatcttcaatcttaatgtcactagatattaattactatgattaattgtaaaaataaaagaagcatgaagattcaggatcgcccctgctttcttcatgctcaatataatgtgataaacaataaagtttgttcaaattacccacttaaacattatgaaattgctacagtggctttttatttattacaataaatcttgttcaaaaatagtcctagtgacattaaattaaaattactttgtacaataaagcttgtttatttctctattataatattattgtcctttaacatcttttgtgtatgtagtaacttacttaaaatttatttattggaaacgttaattcttttgaaattcttgagattgtaatatttatattattattcttcatgtcggttataacattgagtacttttttagataattcactatctctaattttctaagtaacatgcccttttatcttcttatgatctatatgtttatctgttttctctggaaatattgaataaagccattctttcctatatctatacatccatacaaattgcttttcaaattttctctttacatctgatctttttaacttcgaattttcttttatcaatgtaattatatataacttatattgttcttctagatatcctaaatattttgattctttttaattatttaatgaatatgttttcattttagaatttaataattcagaaatacctaattcttttgcatataccccaactgtttttccgtcacactccattattctagctatttgggaaatactataatttcctgatataatatactcttctaattccttcatccaaacctctttataactttttactgttcttttgcatatctgtcatccgagcccttatctggtcctaaccttgtatattaatatccatatttgcatttaaaaattccaaatggtttatctgctgtacttctatttgaaatttctaagtttgtcactacatcttttttataatgtacagctacaggatttaagcatggccaagttccttctccaaacggtctatattcagtttccttaaaattgattatatcttttaaactaccaaataaaaattcgataaacagtatattccttattggatttactaatgtttttcttttaagcaacatttttgtccatgtaaatgcactgtctatcataatattagattttgatatatctaaaaaatcacttgaaaaaaatcccaaaaatccaacatctacttttttccaatttataattcccgtattactagctaatcctttttgcattagcattactttataccttcttataaaatttccttcactcacataagtgtttttttcttcaaatgaacaaactgatttgaaaaatgctgcaaataacaaaggaaatctgttatctcagttccagactctattccaaaaagattacagctactttttctacttccagaatttccactatattttttatatctgtgaatagcgctgaaaaaatttcttcacttaatttagaaataaccactttcatgttaacacttataataatttttcattaaatatacttttacaacaaaaaatgtatgttttatgctaatagtattgaatctttataaatcattcgctataatcattcattatatgtttatattatttaatatatatgagaggtaaaaatgatagcatcaatagccaatttcttaacagaatatttaaacaaaaataacagttctttaagtaaaaacgatgtgctaaaaattcagtactcgctacaaataattttaggggatttaacaaaatctttagtaatattatcaatcttcttatttgtaggtcagttgccactatttttcttaatttttattattctaaattcaacaagacctttaatgggcggcatccattgcaaaacatttaagtcatgtctggtatttagtataatgtattttttgataatattattatttagcatattctcttcgggactaaatacttattttagcgtgtttttttttataatatcatttatcataacttttattaatgccccatgttgtaatgaaaagagaccaataaaaaataaaaagatattaaaaatactatctttaatatccctcactttttggtgtatgttattctttatccttagaaatacacaattatgtaattgcatatttctaagtttattaatacaaattactcaactaattattgttaacatgaaaggagttatttctaatgcaaaaattaacgaaaattttttcaactttactaattaacctatttggtttaatatcaaacacaagttgtgcaggatattacggtgagccagattatcctgaagagttattaaaataaatattgaaaataatttcttttaactctaatttaacttcaaggcaacctttatgtgaggtaattacttgttctacattatacagtccatagcctcttgtgtctgtatttttagttgaataacctcttttaagcatctcatttaaattaatattattcgaatctgcaatttgatttttaactattaaatgagatgtttcattttttttaaaaatttcaatttcgatattctttttgatacagtcatacttcattacttcttcaaaggcattgtttaataaattatttaatacattagatagttcattatagcttaaaatatcatctaaaacattattattaactttatacttaaaatcaatattatatttttttgctttacacatgtttctatatattatagatctcataactacattattaatataaataagttcatttatcttatcatcatatatgtcctcatctttaatataatttctaatttcttctccgactttgtctccatctacaacttctactattccttttattgtattcttatagttaataaaatcatgttgccgttgttttatttcttgaactatttcaccaattacttcatcgtattccattgatactttaaatttctcattttctttcatttctttaataatagaagtatatataagtatttgagaaataactgatgtactaactattatcgctgtaattggtaaattatttgaaattagtgaatcatcataaaccaaaataatcttaaaaattataacatccatactaaatgtcgaaatcaaatacatagaaatatcattatttattttttcaaagctaatgttatcacttaaatttaattttgaaaaaataaatatagttcctaacgttattagttctacaataatcgctttaatatcatcattacaagaatatacattcataatcaacgaaattaccagttggaaactcatttctataaataatattaaaaaaaactctagtattatatcttttaacttttttttacatgtaattgttattcctgtgattaatactatatatgatagaataaaattcaattcaaaatattcaacagccgtgactaagattgaacaagtaattatactaaacaataatctatacaaactattattttttttgtttaatattgcccataaataaattatgtttatagtatctaaactatttataaaaaaactagttatcataatatttacctgcctttttaaactccggtataatattatttctaaatttaatccctataagagcagtttggggataattttcaaagtatacacagcttagtctaatatctaccttttctattttaaatatatgatttttatttatagcaaatgctctatggctttgaactatgtaatcacaatcaattaaatctaatatctttttcaaacttatattaatatatgtataaattcctctaacggtatttacttcacaatctctacctttaacttctatgaataaaacatcatttacctttactcttacgaatatactttttcttatttttataatgaattccttctcctcaactttatttaaattacagatcgccctatcaataagtttatttaacatagattgtatatcatctttattataaggctttaatatatagtcataacaatgcgtttgtttaaatgcttgtaacatataatccatatgagttgttaaaaaaattagttgactaaattcatatttaggaatgctcctaatattcattgcgagatttaatcctgatgaaccttttaaattaatgtctattaaaaacatattaatgtcattatttttaactatatctaaagctgtactctcactatcagcttcataaatttttataaaattacatacagataaaatcattttttttaaaatctctctttgcgtaaattcatcttctactaaaataattgaatacaaaatttcccctccaattttatataacctttcatcaatataactttcatcaataatttgttgtaattctccagtttgcatattacaagtttcatcatcccctttgcctattaaaaaaactttaaaaattaagcctacaaatatttttccaaaaatgcttacaatcttttaataataaatttttaactattagcatcgattacatttatagaatacaatatttttaaaaaatatacaaatttttcattatataacttgcaatattagttttttttaagatgctaaaacggaatgttgttagatttgtgtacgacaaatttgctacattattttttttcgttatttagtcgtctattttgatttaagtacacatggtttagcgtgtacctttttaagacaaaaaaatatacgtaacagatgtttttaatctattgcgtatatcccgtattcttatataattcatataagaatacacataactctcatctaaatcaaatcaaaaataagtattcattaaatatatttgttgacaactataactattatgataatgtaatccaagttttttcaatctcttgttttaaaatattatagttattaatattagttcttaattgaagatctaaatccatactacttaaaacttgattatcataattagatttagtgatcatctccaagtcatatttaagttttgcattactagccgtttattatttaaatcaatattcttctttaatgtagttatactatcttctgtagtaagaagatttgtataaagagtctttaactgatttttaagctgctttttattttgatctaaattagctaattgtttataaacatctgatttgctatttaaacaagctaatctagctgacaatactcctgtatatccatttataactttatcataagtatccattatattcagtagtagtttgttgagttaatgaatcttcatcaaaatctctttgttgtttaagttgatttaaagtgttgtctctagtatcagaattcaagtcttttttatatcctgaagtcacactaacatcatcaagattttcacttaggtcattactttgatcttgttaatttatttttttattattgattgctattttattactattgataatacctccgtttatagcatcttctaaagtaagtattggttttccacttgcttgggtttatacatttgtaactgtagcaacattttgtacctcatcatctgcaaatgcaggtataacacttccactcataacactaattccaatagcaagagtaactaatttatttatattctttcccatgttttgtctcctttttattaaattcgacttggcatacattcatattttatagctaaagaaattatctaaaattaaattttgtattccttctttaaaatttcatagtctaatatatttgaaataacatcaatatcaaataatacactttagacaatgtctactaatctctatttttaagtgcctcacttaacgatattgttttaatatgtctcttaagtaatacatcacttataaaataaccaaccattaccattatcactacaagacaataatctttaggttctaaactaatcgaataatacgcttgaacatcagctgtcattccaggatacattaattttataatttttacagatatgggtattgaaataactatggaaaatagcacagtatatagtaagcttccaagatacaatttatttatctctttttgattaaatccaaaaattttaactaaagagatacttgaaatgctcttgtcaaccattgcttttaataataaatacatacttattattagtattgcgcttgaagatattacaataaatgcaattgttgggtacatattatatgtgttatcttgtgctgatttaattgtatttttatatgttacttctgaatttacataatcatcattaatatcaagtttatttttagataaatatccattaaaataatatttatcctcttttaacagacgatttaactgacttctattcataaacacattgagaccagatttgtattttacaacacctttaatttttaaattaaatattttattttcacctttatcttttaaagtaataatatctcccacatttaaattaaatttaccttgtacactatctgatatatataaaccagaatcattttctggaatactaaaagaataaaaattagaatgttcattaattccttgaagaattacatccatatccatctctatatctttagaatatattgataatcctttagacgtaattttctcaagtcctttattttcagtaacttcaattggacgatttaaaatatacatataattataatttatttggtcttgaataatttttacataatcatcaccagtacgatatatgcagactccaaaagcaagtccaaaagttgcaaaaaaaattccacaaaacaaaataatatttcctctaatttctcttaaaaattctcttaatctaaacttagttataaaactaaaatgatttatcttaacattatttaatttacttgctttcttttcttttctcaataattgaagaggtgtactattaagttttttagagattataaagtaatttactattattactattaatataggaataataacacctataaaaatcaaatacggtgggtatattcttgtaatattaggcattgaataagtattagtagttgctttctctaatagatcttttatcacaaaccctaaggatgttcctataattgcccctatactaacaattattgttggcaaaatcataaagtgttttactatctctttctttacatatcctaatgaatataatgctccaattattgcactctcttcatctattgtattaataatcatcatggatatcatataagctatcattatacatataacaaatcccattaatattgacatgtttttattcactttaatatcatctatgtatcctatagcccttgaattatccgatattttaataaattctgttacagtcgaattgttagatacaatgtttttaaccttatcaactggaaccccatttagtttaaatacatatgaataggatttatcccttaaatttttaaaatcttcttcattcataaaaccaataccaaaattctttggagttggtgttagatcactagtcttcttaataatacgagtgtaatctgatgctgttgcatatccaactactttaaagtttttcttttcaataattaaattattcaatatcttataatcattagcttcaccaaagtgttcatctataactatttgattagacccatttaagttattacctttttttattgatattttatttatattttttctatccttaaatattctaatagtttgattttcaaaaagcttataatctacgtaaaaattttcttcaatatcgactcctaagctttttatcttttctaatgtcatatcacttaattcacttttaacataaaattctccatcttcaagattattttggagtgcagcattttgacaagttgacatgatacaatctactgaatttgaaaagcctactattaacatagaacttattaaaatcaatatggttaaccctgaatacttacttacatttccaacgaattctcttagtattcttttatttaataccatttattcactcctctcactaaatatcagttacttttatctactaccaagtaatatcctttgcttccattatcgcttcattttcatattcatcctcaattattccatctctaacttttactactttatgggacatatattttatagcatcattatgggtaactattatcatagttgtaccatattttctgttaacagattctagaagttcaagaatttctttagatgttttataatctagtgcacctgtaggctcatcacaaagtaataacttaggattcttaataagtgctctagctatagcagttctctgctgctgtcctcctgacaactgccttggaaatttatcttgatgttcacataatcccagtgtttttaataattcttctatatctaatggggtcttggtaagatactcacatacttctatattctctttaacagtaaggttaggaacaagattataaaattgaaatataaatcctaatttatctcttctataaaatgctaaatccttggaatttaaacttgaagttgtaataccatcaacagttacatcacctgaatctatactttccaatccaccaataacgtttaatatggttgatttaccagatccagagggtcctaaaatggtgcatatcttcttttcttctaagttaaagttcaccccgtttagtacctgcaccttaatgtcaccttgtccatatgcctttttcgcatctctaacttctaaaaacattattttctctcctatcttccattaatcttaattatgcttccaatctcataatctgaaggagaattaagaacaatcaaaccatctttaatatcttttcctgaaatttcagcattaatatctgtttcagcccctttagttatacgaatctgtttaacaacataatctttttcttgcttctctgctatatatatacaatcattattatctttatcttttattatgctttcaattggtactgtataagttccgtctttttcatctacaataatatctgcttgagctttcatacctatttttaatttataatttgtatcagttatcttaatcttaacttcaaattttgcttcttcatcattagaatcattattaagagttaatgaacttttatcttcagcttcagctattggctgaatacttactacttctccattaataatatctgcacctgtagaatcagtctttacttcagctttttgccctactttaattttctcaatatccacttctttaacatctaaacgtacagttgtattatcttcgtccttaatttcaaacaatgctcctgtacttggatttcctacgcttgcattttttgcagtaattattccatcaactggtgctataattacagcatcttttaaatcattttttaaattttcaattgaaacatgttgactcttatcttcagcttttactcttgcttcatcatacttatttttagctgtagttaaattttgctgcactttagtttttatattcttcaatgatacagtacaattatcaaaagtattttgagcatttttataagaaatttcatatgtgtccatatcttgcttagaaatggcaccattctcaaataataatttgttattctcataaattttctttttattttcaaggtctaatttagctccttctaaagctacttctgcatttttaatatctccattgttttcatcattactttgagttagtgcagtgttatattctgattctgcattagcaagttctactttattacttgcatcagctgtagaaatagttgcttctaattcatttatttgcttttctagtttgtttgtatctaaaaccgctaaaacatcattagccttgaccttatcaccaagttccaccttaacttctttaattggaatagataaatttgaataaacattagtagaattttcactttttacttcacccttataattaacttttgttatatttcctcctgcctgaagaacagtatacttgcttttttctaatccctgatcagctagtaaagtaatagctattttagttcctattcccatagctattaagactactaatataactattaatttcttattagtcttaattgaaaatctttttttgctagaactattcagatcattataattatcatcaggcttgtttataattgatttatttataagtagttttttcattccttattctccttacctatttaatataattactcccgttatatctatataagttgcaataataacattacataataattagccatataaatgcaattgtccatttgaattgtaacctttttaatgcagcttatatagatcatataatttagtaaatattgtttttagttcaccaatatgatgaaattaatttgctaattataaataattttcttatatctataacagttagaccattatatatgatttattttgtgttttagatagttttagtctaagattaatagccatttgtatttttctaatagactctttttcatgtaataatgtatcttctttgaattcacaataaattttaattattttatcccctaatagtattcaattattacttggaatgtttgattttgcttctgctactgttgtagtttttccttttataagtgaagccaccatagcagctaaagcaataattgcagctgctgtaaatgttatacgtagcccatatgtggatactgcctgagacagattcactccattaagaccttgagttgaataaatactattggcatagttagtactataactaaataaagctccacttactgctactcccattaccataccgagatttcgcatagtcgaaagagtgcctgatgccaccccctgtgttgtgctggtacacttcccattactgcactgttattcggagactgaaacaatcctgaacctaccccagaaagaatcatggcaattactatataccaagatgatgtgcccatattaagaaagctaagcataaacaatgcgatagccaatattcccattccagtcgaactcattatacggctatcatgtttgtctgaaaaactaccactgataggtgcaatcaatatggaggaaaccggcattgggagaaaaagtacacctgtcatcataggagaaagctgtaaagtattttggaaatacaaaggtacaaggaacgccatgataaattgagccatatagttgaaagtagtagcaataaggccagctgaaaaagttttatttttaaacagattgagatttagtagaggataatttgtttttccttcatatacaataaatagaacccccaaagcaatacccaatacaattaaaattataaacatggtagtactaatactttcactaccagaaagatctagtggtagaagaatcaaaaacaaagtaataaatatcaatacagctccacctaaatcaaaaggcacagatatcttttttttatcctctggaatatatctgtatgaaagataaatacccaatatacctataggtatattgatgtaaaatatagactgccaccccatcatacttgcaagaattcctcctataacaggaccagcacaacacgctgcagagatagctatggcaataattccgaaagatttaccacgtttattggaaggtacactagcagtaattatagctgaactagtagaaaacatcattcctgcacctagtgcttgaaatatacggaacacaatcaacatctggatatttaaagaaattccacaaagaaacgaacctaatgtaaatgcagtgaatcccattaggtaaatcttcttgtgtccatataagtctgatagcttcccaaaagttaataatacgctacttactacaagcagataagctgtaataacccattccacaaatgcaatatttacattaaaatatttttgtataactggaataacaatgctgacaacgctgctatctaaggcagacataaaagtgcctattgctaatgctaatagtgtgaatgccattttgttactttctatttttgacataatattccttctttcattttcaaatgtgagtctttactcatatttctatcataaaactttcggaatataaagtcaataaaatatgagtaaatattcacattttattgacagactatatataaaaacttaaaatgaagttaaggagatgattacatggaactaaataaagcaattcgaatacctaaacaaaaaagaagtattattacaaatgaaaaaattattaaaacagcgtttaagttattctgtgaaaaaggttattacaagaccactacaaatgaaatcgctaaaatagctggcgtttcaataggtagtttttattcttattataaagataaggacactatttttatgaagatactagatgactacaacaaactttttctagaaataaataatgaatctgagctagctattaacctatataaatcagataaaaagaaatggctacaaaagcttattaataaaatcctaaacattcacgaatcctcaaagcaattgaacaaagaaataaagattttatcttattctatgccagaaatagctgaaataaataaaaaacatcatgaaataattataaaagttattctcgaatacttacatatgtgcaagaacgacattaagataagtgatctttatgttgcatcaattatttcttataatattatttcatctactgtcgaccatattgcctttgaagaaacaattataagtcgtgaacgattgattgaagctacggttgaggctgtctataagtttttgtttaaatgagcatatacaacataattagtattaaaggactaccacttactagtttagttaagctctgagtattaaaatacaaatatatatgttgcaaaaataagactacattcaggtagttaatatgttaagcaaaaatttaaatatttaatgcagaaaactaattgcaatatatataatcgcagaaatgataagagtataaaaaacataaaatttaattgtgaactatttgatttagatgttccgttagactacaaggtctcatttaatccggtgaagtaaagaaatatcagaaagatatatcatcattagaaaatgcttttataggaatgtattcaaaaggcatgacctcaatagatataaaagcataaattaaagatatctatatgattgatgtttcgcaactcgtatttcaaatacaacaaaaaaatattagttattaattctaaatgaacttaaaaatcgtgattttgatggcgttaattgttttaaataaactattgttagagcagtattctctaacaccgaaaaataattaggaaaagcaatcatcattttcaaataatcacccaaaataaggaaaataatacaaataacaaatacaccaaaaacctataatcatctcacttaataaagttccccaaagtaaatcgattttttctaacgatgaatcattgttaaagatactttacatcacaaagaaataagtctaaagatttgaaatttcagctaaattttggtttaactttcaatctgtttcgaaaatttactcgatgaagctttatttaaaaaataaaatggaaggaagtcttgttctccctccaaccttataaaataagtatattacttttgaaatttacacgaaaatcttgacaggctcaaagcttctctcatactgattttagtattcctattcccttgctatttactataatttcttaatagagtcattctcactatacaattcatattaattaatttcatttattgatacgttaaaatctttattacttgtcacttgaagaatctcgctaaatctatctgtttgctcttctattggtgtcttttttgtttcaaatatattttttaacaaattcatcgattccaagcattcttctttactaggctttctattttctttttctatatttccttgcatttctttcatttttctatatggcttaaccactccgtcttcgtattcagcatcattcaagtttttattttgggtacaaactgctattgctatacacttggttactatagtgttcatataatcatttacactattatgatttttcttttcacctcttgttagatactctatagcctcatcttttcctccttcaaaagcataagattttatatttaactcactcttttttagtaaatttttaacaatacttttaggccctagatcaacagcacaatcaactccgtttcttttcaaatattccattgtttgtatccattttactggattaactatttgattaactaacttttgttttatttcatttttatctatatatggtaatgcatctacatttgaaattacgtttatatcaatatcattaaattcatatttttctagttcttctttaaattcttctactacaggttccattaatggactgtgaaaagctcccttaacatttaaaattattccgtcttcattcatctcatttagtttagaaataacacttttaacagatttttcataaccagatatgactatttgatcatatgaattaaagtttgctattcccacataatcattctcatcagttgttgtcttacatatagcttgtattttttcaagatttgatccaataattgcggccataattccttttttattgtaagatgccattcccattaactcacctctttttttaacaatctttattgcattttctaattttattgcacctgaacatgttaatgctgttatttcaccaatgctatgcccacatataaatttgggcttttttttcatttcttccataaacactttaaatgcggctactcctgctaataaaatagctggttgcgcattttcagtatttgacagttcttcaatatttccattaaagcataaatctctaatattaaagtttaatatttcatttgcatcatcataaattttccgaactatcccatagccatcatataattcctttcccataccgatatattgtgatccttgtccaggtaataaaattgcataatctctcattctttgcacctcattctagtatatttttctattaaaataatcagtcatacatatatgtaaattaattattagatatatgccctgcatgtagtctgtgccaattttgcttcaaagtatctaataataaacatttttatactcaaataaacttcatcatttaataattttcagtagttgctactgaactaaattacaatctactaaattatagaactcttcaaaatcaaaaatttcaattcgttttggaaattcttttttattagaacaaactgatagcttataacatggatcaagtttatattctttaaaataatacttattatcctcatataaacaatatatattgttttcgttaactatgtttatattaaacgaatttaatggcatgtacaatccaaagccctttgctttaataaaactttcctttaacgtccataataaatagaagtattcacgcttttttgagttacctattttccggaatgcttcatattcttgtacgctaaaaacctttttacttaatatcaaatcaatatttgatatttgttcaatatcaatccccactggttgattcccaatggcacaaactatgaactcattagaatgtgatatattatattcaatttggctataatttttcacaaagggcttcccgtatttatttgtacttaaaataatttcactattttttactttcaacatatcgcatataaaatatctagctaatatttcagatatcaaacctcttttcctatcatctatttttctgaatttcattaacttatcagctttttctttagatatatatctgagaagataaactaacttatcttcttccttaaaattttttatacttacacagtaaattgaaaacatatttaatcctctttagttactgatcattgctcagccactctttcattaattacttagtgcattttacttaagaaatatttaaatttatcatttttatacatctcaattagtcaaaattatattatatctactttagaatttttcttcattttgatttcagtattttatacattttaatgtttttgaaaatactctcacaagcgaattgtctagctcttacttatttataattctaagaaatccattatttccatacttggctctttatatttcaaaagttgatctccatcacagttaaagacaatatgtttagtatagcctttcctgctcttttcaatgaattcacacatccctttactaggccagtaatggtctttttctgttgaaatcaaaagtaagcgtcctttatattgatccactttaatcaaagcattcttatttttattcgtctgaatagaaaataaatgagaagaattgtacttcttatttttaatatcattaattacttctcggttatacctaaaccttacaaatggaatgtctttattcttaaaagtccagcttgattttgggattaaaatgttcataatccccttaggaattgcttgccatacataacagcttggtacgcaggcaatagctacgctaggattaatatattttgaaattagtagtaaaacaagttcaccacctttattactacccatcaaaactatatcctcatcatttaaatttaacttattcttaaaatggttaatagcttttatgaaatattctaacggaattctttctaacctctttggcaaatctccaaccccaaaatatgctaataataatacattaaacttggattttaaatattccaaaagttcttttgaaataataggtatacctggttggacgcttccaattactattactaagggtttttcatcattttcataaaaatcaccatacaattcttcagttctatattccattgctttcctccacttcatattgttttaatcactataatctccaagatatataataaatagctcttgctttcgtaaagattagtttaatatccataataaatacattaatataacctcagcgacaccaatagatgaagagtttatcctttatcaggtataaagccgaataacctaaaattttgcttttaaaggataactctaattacaaatataacattagtacaaaattattttttaagttatatattctcccccattgaatacaatgtaagttagcctcgtggacactaactttcttagactttaagcaactgacgctgcatctttccagaagatgtacgaggtattttttcaataacctcaaactgtgtaggaattttatatggttcaactctatttcttaagtaagctattatttgtgtcttggaaaaagcatttactttcttctcatctaatacaatgaaagccttaataatttctcctgaaatacctaatggatcagaaacgccaacgcaagcactttcttttatataatcaatttcgttcaaatattcttcaatttcatcagggctgacttttctccctccgacattaatgatttctttcttacgtcccttaaggtataaatagccttcatcatcaagttttccataatcacctgtatctaaccacccatcatttagtatatgactagtcaattctggcttatttaaatattgcttcataacatggtctcctgaaacaaagattgagccttcacttccagaagaaagatcgtttttattctcatccataatttttacttttacatttggtgctgcctttccaactgatgtcaatttctctttatctctgtgaaattcaataaagcatgagcgcgacgcttctgtcagaccataatgcatgcatattctagtatttggtaggagttccattaatctttgtttcatcttcatctccattggcgcactaccaatctcgataaattttagttgatgtgcatattctcctaacttatttccactcaacttaagtagaagtgcaaatccagctggaacagaaacaaaaccagtagctttccatattttcatattatcaaatatattttttatattagcgacactttcacacataataatagttccacctacaagcatattacaacgtaagcgacctaatccaaatgaatgactcaatggcagaggcactatctccctatcatctgcggtattaccaataaattgattaatattttgagctgctgataatattcccttatgtgttaaaacaactccctttgatctgctggtagttccagtggtaaaaagtatatctgccacatcttctccaactggtatgacattgaattccttatcattatatatagctggtaacattagttcctctattgaaattgaactagcagtttttcctttagctaggaacaattgctttgcattagtttcttcaataatcatgttcaagtttttatcgcttatttgaggatcaacaggtattgcaattgcccctaaaatatgagtagcaaaataaccgaaaacaaatgcaggtgaaggtgtcgctgataaaataactctacttcctggacaaactccatattctctcattatctgtgcagcatttaaaatactctgccctagctctccataagttatttttttattatttactataagtgctattttagacggaaaccgaattgtatgtttcattactactgaaattaatgtctgttccattaaatgttcatccctttcatatattcaaattaaaaaattatattaacccaaatgctattaatatacttcctttaacatattaatataactatcacttattttatgatgctcttgtatttgtctatttaaatcctcagcctgtgctatattaatagctttttcagcgtatttaagacaataatcacaagaagaacaattctccttacaaaaattcttatttaagaacggttccaaaaatccatttaaacttttattatcaatataaggtaaattactttcataattattatcttttctaaataatgtaaataaatcaattaaatttccattatagttttcttcaaaataacattttaaagtttcaactggatttcctttatgaacagattgtctaccttgaattttaaaataatttactcctatatttgtataatgttttaaatcctctggcctaatccaattaagtttaagtggatttcttatgtccttagaaatttgatagatgcatctgttgtaataatatcctgatgctttattggatatttcttcatgattatgtgattcatgattgtaatgaaacattttatatgcacaatttttcatacataaactattaacaataacttctacaccatcaccaaatacagaagaaatttctttaatactatcaaattttcttgaaatatcttcatctattactactctctcaactccaagtttcttgtaaaataaagctttatttgcagaagaaacttgacatattgctgatgtttttattttaaaatcaaatccaaatgtatttattagttcgataacagaaggcattgctactgtaagtgatgttacaccaatattagacaattcttttaaaaaattatataattggttcattccactctttgacaattcgttattacccatgcatgatgaatttaatgtataattaaattttatttttttatccaaggaatactttacatatttctcaagttccttcatatccacttgtggtaaaattcttaatgatcttcctgatccaattttattgaattctccaaaatcagttaactgaccgtatgtttcaattaattttgaatcctcatatatattatttaattcattatatttgtcaattgtgtcgttaataaaatctgctggaatgctaaaatatttcatacattttaatctcctttttatattatcaattattagcttctcactgaaaactatgaactgatgtaattgtgatttaaaaataactccaaatatacttttattactaaataaattcaatctgtttaaatatttccatcattgtatgaatatcatcttgctgaactacaggccatttaaaattaaatttttctagaatttttgtcgtctttccgcactgaagcaaagtcaacattcttgaaggatgtaggaataataaaatagctagtaagtcattgtttatttctatatcaccattctcttgaaataatgtttcataaaacgtactaaattccaacctatttaaattaataccttcttcaaccaagaaatcacctaattcatctagacaaatataattggaattatagagatgaaaggtctcatttaaaatattttttttgtcaaaaataagtgtaatcgcctcactcacataatcaacaaacgaaaagtccatatacttatttttatcatttgggattactcctaattgaatgaaagacttaatgagtctgtatataccaatttcttcatattttttttgacattttttagtccttttattataaaatatttctcctactctatatatatttccattgattcctttctctctagcttgaataattaaacgctctgcttcatatttactttttaaataaatattattcagtttacattccaattcgtcaacgtattctgtaaataaataataatctgtacgttctgctaaagcagctacaccacccgttgaaatctgatgaatatcttttttgttgccttttagcgaaaactcaattagccttttcactccatctgtattaatactatagaaatcttctgcaagaccataatgcttgatattagcagcagaattaataatacagtcaattgtatcagacaatttattgtattcttcctttgatacaccaaaattatcctttgctagatcaccattaataatatgaactctttctttaactgaattaaatccatttccaaaataatatttataaagttcctcaagtcgtttttcagcatcactctttgtattacctcttactaacaggtatagttcatattgtgaattagttagtaaatcatgtagcaagtgaatgcctaaaaaaccagttgcaccagtcaataaaatatgctgatagttgttttttgtttctacatcaacatcttcatattttaagacattatttttataaatttccatatcattttctaaaacatacttggactctttattttgtcttgctgtataagctagttctttattttgtttcatcaaagttttccagttatcttttttatacttaactctatttgccaaactgctaatagtaggaaactcaaaaatatcattgatatcaaaaatgaagtcagaacttaattccattgcgatttgtactatagtataagaacttgctcctaactcaaataaattatcctctacaccaactttctcaatacctaggatatcaccccaaactctcgcaatagtccattccacttcagttctaggttctacatagctgtctattgtatttttttcatccaaaacccaactttctgattttgtacctaaatcaatcttagatatacaaatattaggttgatttgttacaattgttaagaagttaatatattgatttaacaaattttctgctaattctatatttaatccatctatatattctaatttaattaagatttcattttcctctgccttaaaactaaaaacagtatcaattccctttaaatcttcctcagatacttgatgaatattctctaaaactataattgttttacaatatgaaaattcatcttgtatgctattcttagtctggcattcaagattttcacttactgtttttttcacattagttagcatatccttatatgtccaatgtgtatctaatttatatctaattggtaccattctattttcagatatattagaaaaattttttccatttacaggcattcccaaaattccatcagttaaatctgaatatttatatgccaagaactctaccccagaaagcaaaatcatataaatacctaactgagacctattagctatttttcttatcatttctgaaactgatattggtatgcttttggctatgcactttctctcagtcagcatagagggcttatttgattcatttacaaaactcttaaagccaacaaacttatttattgatttattacaattcacttcaattttagacatttttacagcctccatcttttaaaattttattactcttttatttatatatgttgcagttacatttctacatttttctttagttatttgtttaatatataaactatgtgaatgtagttttatttttgctatatatgttaatcaaaattaaattctacacagtctaacttcaaatctcctattgaatcatcatgtttatcagaaactaattgttctaatttcagttctttattttcaacaatataatttaaaatttcaagatattcttctctccatctatcaattgtttcgcttttgaaaagatctctacaatacttaaaacgacaattcaaaacagaatcatgctctattatttctaaagtcaaatcaaatagagcaatttcattttcaatctcatatctatctacttttacttctgtacaattcattttaggcattaccatattctgatactgaaacatagtatcgaataatggattcctacttgggttattgtgccaaccaagtttctctacaagtatatcaaatggatactcctgatttttaaagactttcaaaacttctttgtttatttttttaacaaaatcagccagcaaataccctgcttttggtttcgtaacaatagctacactattaatgaatactcctactaagttttccaattttttattttgtctacctgctactggggttcctattactatcttatcctgacctgaatttttggataacaaaatactatatgcacttaataaaggaacaaacaaagtacagttattttcatatgcaaactgctttaatctgctttttaaatccttgttaatcgtaaaaaagctattttttcctttatagcttctgatatctggtctggtataatcataatgaagctgaagtagtgtattctgctttgaaaatctcttcaaccaaaatttttcttgtttctttaagtggttttcattaagtattttattttgccaaaatgcataatctttatattgaatggttatttccggtaaaggcagattagagtataaatgaataaaatcatttaaaaatacaccatgtgaagtcccatccgtaataatatgatgaaaatcgtaaaataggtaatggcgttgctcatccactttcaaaatatgaaaacgaaataaaggaagttgttttaaatcaaatggcttaataaagctttttataatttcatcaatattattctcttttacttcatgccattccagtgaaataacagcttcttcatgaactaattgtacaattttcttctctttataatcgaaagtagttctcaaaatttcatggcgatctgctactctttttaatgtgtccttaaatttattgaagtcaatttttccttctaaaattagaactccaggtacattataaacatttttactcattaagctagtaataaatatcctcttttgcgatgaagaaactggaaaatattgtttttcctcaattggtagtatatcaggcaaacttgactctgataattcgctatctatatattgtgcaaaatctataattgatctattttccattagattagtaatagctatatttttattcatcttagaattcactagattaacaatcttcgcacctgagatagagtcacctcctaactccaaataatcatcaaatatgttaattttattagcacccaacactttgtaccaaattttagcaagtatcttttctgtttcagtgtacattccatcctctcgccctgccaatactacttttaaatgttcatctatagattcatcttgtttttcattaatttcatattctttaagaatcattgctattttctttcgagcttcatcaggcaaattttcaacttctaatagtccattaatattagacattccaacattgtactttttatttggcatatctaaccagcatcgttctctttttaaaggatatacaggtatactaactcggctccttttctcacctctatatagctcatcccaattaacatctcctccctttatgtacagatcacatactgattgaagaattgaaatatcctcttttttaactgtgttatagtatttcaattttgaattagcttcttcactaaattgcagtttctcattattagaaatatagtttccagatttagatacattttttccactcaaaaggttgtagcttccaaaaaagatttttttcaattttttagtttgctcatcatctaatggttgctttttaatacaatttttaagtaagtctatcaattctgcttggtcttttggcaaaaataccaccctacattcatactgtcctctaccagtatttgcggtgtaacagaaatcatgaaaattaatagttttatctttttcaagataacccagataacttttcaatagttctatgagaacttcttgactcttagctgacactgcaagaacctctgttgacttagctggacaaatagaattaactgttttaggagcttcttccaatacaacatggcagtttgtaccactaaatccaaatgaacttataccacaacgtctaactgaatcaactgcctcccactttcttaacttatcattgacataaactggagacctttcaaaatcaattctttgattaggaacattgaagtgaatgctcggtgccagttctttatatttaaactccattataacttttatgagtgaagataaacctgataaatcataaagatgtccaatattgcttttcactgtacttatagcacaaaaactttttaaatctgtatacttactaaaagctttagtcaaaccatctatttcaataggatctcctagttttgtgccagtaccatgagcctcgatatagtttattgtagtaggatcaatacgagcatctttccaagctttttctatgacgtctgcttgtgcaacaggattaggagctgaaattcctatggatcttccatcttgatttatggctatgcctttaataacaccataaatatgatccctatcttttaatgctttatggagaggctttaataaaactgccattgtaccttcgccaactccagtaccatctgaactttcgtcaaatgctctagttctagcatcagatgattcgattcctaacattggacgctcttttaatggtagaagataagcctttgcacctccaacgagtgccatctcacattcattttctcttaatgacttgcaggcagttgaaagtgctactaatgaagatgaacaagctgtatcaataagcatactgggtccatgcaaatcaaaagtatatgaaaccctgctaggtaatatagctttagtattggatgaaagagcttgaactaaaaactctggttctgatttattaattaaatctatatattgaatatcacctaagtcactcattcctacaaacacacctgtattagtgcctatgatttttttaccaccataacctgcatcttctattgcttcatatgctgattcaagaaataatcgatgatgtggatccattaaattagcatcttttggtgatatatgaaaaaatgaataatcaaatttatcaatttcattaagaaatccacattcaaaatactctttattcttttcacaaaaaggttcaatatctttttttctgctatatggaaagttttgaatacaatctttaccattttttatattttcccagtattcctctacattgtttgctaatggccactttcctgcaatgccaataatagcaatatcctttgatgatatgctttcaatctgagttctatcatctgctttattactctttaatgtcagtatatctaaattcatttgttccactccttattggattttttgataatatattacagcattttgcaattatttattcaactaatatttacaccattagttttggatttcttcttagcataatgcatattagaatttcatcacataaatctaatatgcaccatgtatatttttagtctatcttatttatggaagactaaataacttaaaatttctggattaatatatagcaagtaaatatctagtagatttttttgattccctaacaaattatatgtctaataattttctacaagcagttcaattatctgattatactgagatactaattctccaacttttttagaattaattttgaaattattataagaacaactaattatcatgttggactcattctcttcaacttctaaaatcaaatcataaaaatcaactaagttaatttgttctgtaagcagactattatcataaaaaagtaacaatgctgacgacatagcttgttttttaccctggtacgaattcaaatcttttacttcaaacaacctttttggttcaatttgtgacatcttttctttaatgatttttagaagttctgaaaaatcatctactttttctaaggataaaccaagtgaatacacaaagttctctctaaataatgtttgaatctctatttgattattttcagttatctgagcaattaaattgctatataatgcaaataaaatatcatatttacttacatgttcattttttgatatcagctctaatttttcaaagaggcggccttcaattgataattgatagaattgatcctctaaaccactatcaactgtgaaaaattcaactggcatttgtagagggtaaattggtaaatctcttttcttttcctcaattttttcaagtaattgagctaatttagctattgttggatgagaaaatacatctacaatttttattttattaggatgttcttgttcaagctgtttatgcattttaaccaatagaacagaatttccgcctaactcaaagaagttatcatttataccaacttgctcagcatttaataaattttgccatatttctgctaatttagtctcaattccactgtttggtgcaacatactctactcctgtttctaaagaatctacttctggttctggcagtgcctttctatctaccttaccatttgcagttaatggtatcttatctaatatgacaaagtatgatggtatcatgtaatcagggacagtctttccaagatgttctctgagttcccctactgatatatctacatctgatactacatatgcacataaatattttcttccatttgagtgacttctatcaataaccaccacattctttatagattggtgttctaatatcctattttctatctctccaagttctactctatatcctcttatttttatttgatggtcttttcttcctaaaaattctatatatccttccctactcattactccataatcgcctgtgttatacaatcttccaaggtcaggatgattaataaatgcattatttgttttttcctcatcattcatataaccttcggcaagaccttctccgccaatataaagttctccagctattcctataggacatacttctttttcataatttaatacatagaacttttgatttgctaaaggcattccgtatgggatactattccactcttcattgacctcatctataggataatatatggaccatatagaggcttctgttgctcctccaagacttacaacttcggcatctgcaaacttatcctttattttttctggcaatgttagtggtatccagtctccactcaacagcactacccttaaactttcattagcattatattctactaagtttccgctgttatgactattccaatagtctacttcatcgctatccccgtcttctgacatattatctataagcatatccataatagcaggtacagaattccatatagtaataccattgttatctattaccttctgaatattttttacatctctttgatcctctatcattacaagagctgctccacttgataaagcaccaaatatatcatatacagaaagatcaaagcacatagatgataatcctattattttatcctcttcatttacatcaaacttctgatttatatctattattgtattagctgctgctttatgtgtaataattactcccttaggttttcctgtacttccagatgtatatattacatatgccatatcttcaggatactcttttgtataaactctttcattgctgtagcttgctatattatcttttttgtaggaatctggtaataattccattttacaattactattctctagtatatattttcttctatcttctggatgttctggattaattggaacatatgctgctcctgcttttaatacaccaagaatatttactatgctttctatacatctctcagcaattacacctacataatcatttcttcctatattcttctccttaaggaaatttgctactttatttgatttttcatctaattccttataagtaagtgtattctcttcaaacattacagctatattatttggagttttctctgcctgcttaataaacaatccatgtaaagtttctttacctatttcttgttctgttgcattatactcgtttataacttctaaatctgatgattttgcttctaatctgtattctttctcttctataatactttcaagtattcctatatactgttcaaacatgttttctattaagtctttttcaaacaactgctcaacataatcccaagtaatgctgattccaccatcaacttcaattatctgctgatcaataaatacttgcgatgtttggcttacagacatttttacatctccaaaagtattagtcgcactttctcctatatctactgtatttccaaacaacatactagtaaatacaattggcatagctgccttgtttccaatattatgatatttagacagttctccgataaattccaccccatcataatgacgatgttctaatgcttcagcaaatacattctgaacatatttcgctttttcaaaaaaagttgctcctatctttaaatctattcctaaaagcataacagaggtaaaatctccaataatactatttacttctccatggaatggatacctattgaatattgttgaattgattgctaccctatcctgattactccaatatccaaggacttctgcatatgctgtacacaatgctgctgcaggtgtaataccattttcctgtacttttccttttattttattccactggttactattaaaagccttataacatcggtcaaaatgtggctgacctatatttgatggatctgttttatatggaagtacaggtgcctgtggaaaactatcaagctgctgtaaccagtattccctatcctttttataaacctcaccatttttaaaatcattataagcaagcatataatctctgaatgtacaatttatttctggtaaatttaattttgggtcatcataatatttcataatctcatgaataatcatcaatatacttgccccatcagctattaacatatctaaaccaaagaacaagtagtttgtctcatctgttagttttaacattttaaactcgaatagaggccattcatcagttttgaatacatgatgggatttttgttttctttctttcaatatatatttttcctgatctttactgtcaagctggcgtaaatcaacaacttccatcttatattctggaactttatcaagtatcttctgctgcccatttgaaagaattactgcacgcatcattggatgtctagatataatcttatttatactattattaaatctttcttcctctaactttgtttcatattctgtatatacgtgggttgatactccacctagttcaaatttatcgtctcttcccattaaatatgccatctgtatacctgttaatgggaatggttcatacattttttctttatctggaactatctctggatatacaatctttactgtacttgaagcacttccgtttgaagtatatctgcttgaaattaatcctgctaacttggcaattgtgttcttctccaaaaactctctaaaattgatttcaactccaatttctctatcaattttagttatcatctgtaccatcattacagaattaccacctagctcaaagaaaccatcattaattccaacctggtcaagacctaataaactttgccatattactgctaatttattttccatttcattagtaggtgcagcatatgctgttcctaattcaacatttccgtctggttcaggtaatgctttcctatctacctttccattggcagtaagtggtatctcatcaaccattacaaaatatgaaggtaccatataatcaggaagcagttcttcaaggtattctctcacgccagttatagatacttctttttcccctacaatgtatgcacaaagatatttccttccattttcatgggttttgtccactaccactgcatttttaattcctttatactctaaaataccactttggatttctccaagttctactctataacccctgatctttatctgttgatctttacggccaaagaattcaatatatccttctctatgcaatactccatagtctcctgtgttatacaatcttccaaggtcaggatgattaataaatgcattatttgttttttcctcatcgttcatgtaaccttctgcaagaccgtctccaccaatataaagctctcctatgacttctacaggacatatgtctttattgtaatttagcacatagaatttttgatttgctaaagggattccatatgggatgctcttccaatccatttgtacttcttcaacaggatagtatatagaccatatagatgcttccgttgctcctcctagactgataacttctgcatttgagaatttattctgtatcttttctggtagtgttagaggaatccaatcaccacttaatagtactaatctcagactatcattatcactgtagctactataatctactgctacttcatttccataagaagattgacggtaatcaacctctgttccataatctattccaatattatctagcagcatatccataattgctggaaccgaattccaaatactgatatcatgttttttgattacatcattaatgttttttatatctctctgatcattaatcattacaagggctgctccacttgataatgctccaaagatatcatataccgataaatcaaaacacattgatgataaaccaatgattctatcttcttcattaacattaaacttgttattaatatcaatgatagtattggcagctgctttatgtttaaccataactccctttggttttcctgtacttcctgaagtataaataacgtaagctatgtcatctggataaatgttattcttcaattttttgatgtcatatttagatatttccttttctacgtatgtttcaggtaataactgcattctagcactggcattctctaatatatagttccttctttcttctggatgatcaggattaagcggtatataagctgctcctgcttttaggactcctaaaatattcacaatggtttctatctttcgatatgccaatacacctacatagtcccctcttattactccttgctcattaaggtatttagctatttgatttgatttcttatcaagttcttcataagttatggtttcatcttcataaattactgctatactctctccattttctgctgcttgttccacaaacattccatgaagtgtcttttctggtattgcttcacttgtagaattatattcatctaataacttttgatctttttcctttatagttaaacaatagttttcatttcttgaagaaacttcctctagaattccaatatattgctcaaacatattgttcatcatttctttatcaaacaactgctctacataatcccaagtaatggtcacaccgccatcaacttcaattatctgttgatcaataaatacctgagatgtctggcttactgacatttttacatttccaaaagcattagttccactttctgctacatctactgaattcccgaataacatactagtaaatacaataggcattactgccttgtttccaaggttatgatatttagtcagatctcgtatgaactctatgccatcataatgtctatgttctaatgcttcagcaaatacatcttgaacatattttgctttttcccaaaaagttgatcctatctttaagtctatgcctagaagcataaccgatgtaaagtctccaataatcctatttacatcttcatggaatggatatctattaaatactgttgagttaattgctactctatcctgattactccaatatccgagaacttgtgcatatgctgtacaaagtactgcagctggagtaatactactttcttgggcctttcttttaatttgattccactcttcacgattaaaagacttatagcatctatcaaaatgaggttcacctacattagatggatctgttttgtatggcaatacaggcgcttgtggaaaactatcaagctgctttatccaatattctttatccttcttatatatttcactattcttaaaatcattataagcaagcatgtaatccctaaatgtacactttatttctggcacgtttaattctggattttcataatgcttcataatttgattgaatatcattaatatacttgccccgtcagctataagcatgtctaaaccaaagaacagatagttggtttcatcagttattctaaacattttaaactcgaataacggccacttatcagttttaaagacctgatgagatttttcttctctttcttttaatatataaacttcttgatctttactatccatatgacgtaaatcaacaatttccatcttatattcaggaatttcatcaagtatcttttgttgtccacttggaagaattactgcacgcagcataggatgacgagatataactttatttatactcttattaaatctttctgcttccagctttgtttcatattctatatatacgtgagttgatactcctcctaattcgaacttatcatcacgtcccattaaatatgccatttgtatacctgttaatgggaatggctcatttactttttctatatctggtattatctctgggtatacaacctttcctatatttgaaacacctttacttaaaattaaccttgctaatttagcaatagtgttttcttttaaaaactctctaaaattaatttcaactccaatttctttatcaatcttagttattatctgtaccatcattacagaatttccgcctagctcaaagaaactattatttatactaatttgatccacttctaataagtcctgccacattgctgttagtttcacttcgatttcattagtaggtgcagcatactcttcctctgtttcaacacttacctctggttcaggcaattccttcctatttaccttgccattagcagttaatggtatctcatcaaccattacaaaatatgatggcaccatataatcaggtaacaattctactatgtattctcgcagctctgttgtagatatttctttttcccctacaatatatgcacaaagatattttctgccattatcatgagttctatctactactactgaatttctaacaccttcatattctaaaatacagttctcaatctctcctaattctaatctatatccattaatctttatctgttgatctttacgaccaaagaattcaatatatccttccttgtggaggacaccataatctccagttttatatagtcttccaagctctttatggttaataaatgactctgtggttttgtcttcatcatttaaataaccttcagctaaacctaatcccccaatacacaattctcccatgactcctatatggcagatttggttttcataatttaatacataaaaagattggtttgacaacggcattccataaggaatacttttccactcacgccttacttcctcaatagggtagtatatagaccatatagatgcttctgttgctcctcctaaactgattacttccgcatctgaaaattgattctttattttttctggaagtgttagtggaatccagtcaccgcttaataatactaatcgtaaactatcgctgtcactgtaattactatattctacagctacttcatttttatatgaagattgacggtaatcaatttctacttcatcctttatgccgatactatctaataacatatccatgattgctggaactgaattccaaatagtaatgccatgcttttcgattatctcattaatgttttttacatctctctgatcattaatcataattagtgctgcaccactagataatgctccaaaaatatcatatacagataaatcaaaacacatagatgataatccaataaacctatcttcttcattaacattaaacttattattgatatcaataattgtgtttgctgctgctttatgtttaatcactacaccctttggtcttcctgtacttcctgaagtataaataacatatgctatatcatcaggatggatgttattttctaattttctgtcatcatatttatatatttccttttcttcatatgtttcaggcactaactgcatctttgctcccgcattttccaaaatataatcccttctatcttcaggatgatctggattaagcggtatatatgctgcccctgcttttaaaattcctaaaatatttacaattgtctctattcttctgtatgccaatactcctatataatctcctcttattactccatgttcattaaggcatttggcaatttgatttgacttcttatcaagttcttcgtaagttatgctttcattttcataaattactgctacattttctggattctctgatacctgttctacaaatattccgtgaagggtcttttcaggtattgcctcacttgtagaattatattcctgtactattttttgttcttcttcacctatagttaaacaatgactctcttcaccttggacaatttcttctaacatccaaacatactgctcaaacattttttcgattattgttttatcaaacaattcctctgcatagtcccaagtaactgacagttcaccattatcctccataacctgtacatcaataaatacttgtggagtctggctgacactgaattttatttcacctatctcagaccatccaaatcggccttcctcaaaaagaatactagaaaatacaataggaagtactgcttttcctatacctatatttttatagcgtgaaatatcacgaattacatcaattccgtcataattcctatgttctagaagttccataatttcattttggacttttatgcatctatcccatagtgaattattgctgtcaaaatgaacttcaagtggtaaaacagaagtaaaatcaccaagtatactagatacatctttatgaaatggcaatgcattgaaagaggttaagcttattgcaaagtctttttgattactccaattagagagaacctgcataaaagtagtacataatactgaagaagctgtaattctctttccttgtgcaatagattttattttggcccattgattagagctaaaccttttacctatacgctcataccttggctttctaatattttcaggacttgttttatatggcaatgctggcgaatatggaaaatcagcaatctttttctgccagaaatcatgatctcttttataaatatctgactgtttaaaatcgttataacttataacataatccctaaaggaaaattcaggagtacatattttagtatcagggcttttataaagatctactaaactctttcctatatttaagatgcttgctgcatcagctataattaaatcataactaacaaataaatagttacgatcatctgttaatttaaatgatttgaattcaaataaaggccatttatcagtttcaaaaacatagtgggacattctttctctttctgaagagattgcttcctgctgctctgttttattaagatgccttaagtcaacttcttctattttatattccgggaccttttccagaattttctgactctttgtttttgtaataacagctctcatcatagggtaagccttaatgagtttttgcagacagctgttaagcagagatatttcgtattctgtctcgatttcctgataaaaatgtgtacaaacgccacccatttcaatatcttcatttcttcctatgagatatgcttcttgaatacctgtgagtgggaaaggttcatacatttccttaggatttggaatacactctgggtatagttcattgatttttttgtttgattttttcaaaataactttttctaattctctaactgattgattagaaataaaatccgcaaagtttaaatcataatttaaagcattattaacttttccaacaattcccgccattgttatagaatgaagtccataatcaaataaattatggtcaatgcctatattttcataatgtagtacttctctacatatgttaagaagtttttcttgaagataactttctgccttactgcctacattctctgaaaggtgtttatctataaacacatctaaatcttcttgtatctcatcataaatcccactattgtattctttagccagcttatatctctgaatttttccgctgccagttttaggtatttctctaacagggataactcgagaaatttctattcccattttataacttaattcatttttaatttttaataaaagagatacaaactcatcaataggttcattattttctacaaaaatcacagctttttctgactgactttttgaatcaaatattccacaagcagcaacttttccaaattcaatttgttctatcccttctgcaactctttctatatcatttacataaaaattttggccattgacaattatcatgtccttagctcttcctgtaattgtaagatgtccattttctaaaaagccgatatcgccagtaattaaccatccatcacttgtaaaagacctagctgttgcttcttctgtatagtaattatttataatattttttcctgttacctgaacatgtccaatacaatcatcacctaatatatttcctgtatcatcagatattctaacaaaacaatccttaataggtgttccagaattgacaaatatagaacaatcctcatctcctggttgaccatacttaattttatcccctactgctaaaaaatttctattaaggcaattatacttcatatcttcacttggaagcgtacaagtaattcctaaacaagattcgctcataccatataaattagaaagtacattctttctaattccaaatttagacaatacagtcataaactgctctgacaaatctccagatataggctctgctgaaaccataatagttcgtacatgtgaaagattcatatttattgtatttgaatcaaaacaattcaaaaattgtctaaatccaatattaggtgagatcattatggttgccttatattgatctgctttttctaaccacaaaacaggatttttaataaataaattctttgacattaccacatgatttaaatcataggccacaggcagtacatgaaaaagaactaagcctattacatgtgtcaatggcatccaatttaaaaatacatctgatgaatttacatctaaatgagaagacatggattcaatagcacataaaatcttttcatttgttagtacaattcctttgggctctcctgttgaaccagatgaaaaaacaacaaatgctgtatcacttatatctccacaagctatttcaccaattccgttgctcactagaatatccttatctaataaagtattctgttttatttcatcagcaatatcaccacaattttcattatttaatatatctacaatgctttttaattgttcttttgttgaaattagtttaggtttttgtagtattttccagactctcgaaacttgcattatattttcatgtgtgttattacaagataatggtactgaaaccattccacccaaaatacacgcccaagaaaaataaataaaatcttcttctctttcaacttgaaaaagtacttcatctccttttttaaatccctgcacctgtaaattgaataatactttctggcttgtagtaaacaaatcttgatatgaaatgaatttctcttttttctcatcatcaattaccgtaaatcccctatgactaacacttaccttatcttgtaaaactttgcttaaagattttttagttaacacaatatcttcactccccgagttttcatagattatatttatgacttatttaattattctaaaggttttaaaccaccttcaatagtatgaaggtaaatttgcctttcatttaatttgaagtatttttcaatttttctaaaactcatttcaccaattgaacacaagccaacatttaccaattctgctgcctgagtcaaagcagaaatcattattccagcatcaagacatgcataaaaataaccatcagatttatatttagccatattagcatccacattataaattaaatacactgaaaaagctgatgatttaaaaatatctttgttaaagaaaagatgagcttcttcactaattattgaatgatcatttactagttgaatacaattttcatttggattataataataaataccttggttaatattttctatacgatctttctttatgtataagaaaacatcaataggataaagtccaccagcactcgcataataatatcttgtttcattttcatttcttatttgtttaaaaatagatatcattttagaaaaatcatcaaaagaaattttattttcctcatcaaacttacgatatgattttcgatcagctatattttctggaaattcaaaattatcattaaaatatatttttttatctatgctggcttcaaaagttctatttaattgttttttcttaaactccttaagtgcattagcatcatataatagttcatcaccatattctgtttcaaatatacggctttgaggaaaaaatacctcttgtggagttaataaatttgatacaagaattctcttttttattaaatcctttattaataaattcagcctcttttgatctacttctggaaattcattaagcaaattattaacttcaattcccctttgggttaaaaaaaagaactcaggaaacaaattcatcgcaaactcatcataaagaaacatttctattttgagcttgttatcaagtatttcccaaaaaacagagggagaccaataaattttcttactaatttttcttttaatttcattatttttaatattaatcataattattcctccaattctatcttcttaaattcaagttttcaataaaaattagaaatataataaaatcttttttatattaattaatattgttaactaatcgataattaatcaaatcggtaaccttttccacatactcgacaataaaaaaatgtcctccatcaaaactataggttttactttctttttctgttaactcacaccattttagaactttatctatctcaatattatctttgtttccataaagcactgtgaaatcacaatccaatttatcctttctttctctccaaacatagttttcagtaattttataatcagattttataattggcagataaaaatcaaaaatttctttattttcacaaagctcttttggtattccccccaattttataatttcatttttgaaactattcataggtaatttatgtagaaaaaaatgcctatcttgtagaatatgaggagcctcttgagctgcaatgaaaatgtgcgcagggcttgtatgatgttcctcctttattttacaggctaattcatacacaagccaaccgcccatactatgtccaaaaaaagcgtatggacctttatctaaataatcttttattgaattataaacatcatctactgcatcattaaaacaattatataaatcagaaccaaaccgcgttcctctgccagataactcaacattatgaagtataatacactcattcaaatattttttccatccagaatacatctgagaagatccccctgcacatggcaagcagaataatcttatattttccattgtttcaccttcactctatttttatcatttatcatattattaaattccccaccaattaaagtagattagtctaagtgataaacaccttagactaaaagttattaccatctctcttaagcgactcaccaaacattgctggaaacccttgttcaatcttaaatataatttctctactatcactttttactggaacattctattgacaataaaaacatattttataatactacttctagcaatattacaactttactttgctaattcatgaaattttaaagctattgacggttaagcatttttccaatacctcccatcacatacacttcgcttcccagattatattcgtgtatatcatttcactattcttataaattagcataattttttattgtctagagatggcggttttaatcacactattaacgcttaaattaccttttttattattaaatcctcaatcattttttccaatttttcaagtctctcttcaaaggatttcaactgatcactaattggatcagggagagatacttgatctaaatctatacttattttttcacaaagtttatttttttttctttttctcttaatgatacgtccaggaatacctacaactgttgagttatccggaacctcttttaaaacgacagctccagccccaattttcgaattattcccaaccctaaatggccctaaaacttttgcaccagaactaataaccacattatttcctattgttggatgccttttcccagtttcttttcctgttcctcctatagtagccccctgatatattgtcacattattacctatttcagctgtttcaccaattacaacaccaattccatgatcaataaaaactccttttccgattttagcgcctggatgtatttcgatacctgtaacaaatctgttaatcattgatattattctagctaatagtttaaatcgcaatctgtatagcttatgtgctatgcgatgtaaaattatcgaatggaatcctggatagcataaaatagcttccaagatatttctcgctgccggatccctatcaagtatagctttaagatcttctttcattactcttcacctcaacaattatatcttcattaaattacacgcagaaaaagtttacatcatcacacaatttggccataatttttagaatttgcatccacacagtcaaatttgtatgtcccagcttaaaatttattaccttgaatacaaattctgtcataagattacccccattaatacaaaattaataattgactaataacaaaaagtacagtgacattaatttgtgtttttcctataaatatctataatcttaattactcaactaatcattaatttaatcttattattaatttatataaagataacaatcacatattatcactctaaagaaaaatttaaatagaattttcactaaatgtataaaatctaacacaaaaagaaaataatttgaagtatatcagcttattttgaagtataattatttttatgcaaaaatttatacatttaatgaaaatagtattgaatttttactatatgtgtatgaaagttatagtatgattttagtatgccaagataataaaaaaaatcattacaaatttcaaatttcgtatgctatatacttaaaagccgtatttgtgagtgtattttttaactttttttaatatttttttactaagatagactttaccatcacgactattaacttttttcctctccctcgtcatagggcaaacccttgctatatacttggaaatagcaatctacactattggctctcacctgttagattgctatcatactgcgcgtacaacaaataacccgcagaggtaaattcctccacgggtaacataattaacttattcaatatattagttacacacgtattcataaataaaaagtaaatttttatacattatataggctgttgaataaacagaatttgttgtagtttttgaataaagattgattagaacacctttggaaaatggcttaaaaccataataataattttatattttttaacaaagtttgatcaaaacatatcttaaacataagaatttaataaaaatttttataataaagtttaaccaaaactaattaatttttacctagttaagccatttataaaaagttacctattaattttataatgtattttgatcaaactttacaaatgatcgatttttattataagtaatcaaactttgttacaaatctacatttactttatttcttttagccatctggtcatctcctaaagaaaaaagggctagacatttctaattcacttgaaatatctagctttatatgctttattattaaagttaatctttttttaaagggttatactttttttaaaagctacataaattgttttaaattatgaattattctactgttactgatttagctaagtttcttggcttgtctatatcgcaacctttatttctagctgtatagtaagctaaaagttgtaatgcaactacagcaactattggtgaaactaagttaagaagttctggaattctaattactttatcgaaaattgattcatctaatacatcattttcgtaagcaattgcaattacttctgctcctctagctttaacttcaactatattacttaccatcttttctcttaatgatttttgagttaataatgctattactttagttccttcttcaattaaagcaattgttccatgttttaattctccaccagcatatgcttctgaatggatatatgaaatttctttaagctttaacgatgcttctatagataatgcatagtccgcacctctacctaaatagaatacatctgtttcatcagttaaaagatttgcaatttcttctacttcacttgctttatctaaaattacttgaactttttcaggtactaataataatgcttcttttaattctttttctaattccttagtcattaatccctttaattcactgaaatacattgccatcatatacataacaacaacttgtgttgtatatgctttagtagaagctactgcaatttctggacctgccattgtatatagtacgtcgtcagcttctctagaaattgtacttcctacaacatttgttatagctaaagttttagctccagctttcttacaatctctaagaaccgctaatgtatcagcagtttctcctgattggcttaatgttattacaagggatttatcagttactaatgggtctttatatctaaattctgatgctatatcaacttcaactggaattcttgctaatttttcaattgctactcttcccataagtcctgcattatatgcagttccacaagctactataaagattctatctatattattaagatcctcttttgataacttaaagtctccaaaagtgatatcatggctcattgacaatcttgatgccattgtatctctaatagcttttggttgttcgttgatttcctttaacatgaatgaatcatatccacccttttcagcagcatcttcattccaagttactttgaaaacatctttctttatttcacttccatcagcgcttaaaattttagcgccatctttgcttataacaacaaattctctatcttctaaaagatagatatctcttgtatagcttattatcgctggaatatctgaagcaataaatgtttcatcttgtcctaaaccaacaattagcggactatcttttcttactgcaattagcttgtccggttctgctccagttactacacctagggcataacttccttctaatctttcagtagctttaactactgctttaaaaagatctccttcataatagtaatgaatcaaatttggtattacttcagtatctgtttgagatacaaattcgtatccttctcctttaagccattgtctaagttctagatagttttctataattccgttatgaactacagtaatatctccctttgaactttggtgtggatgtgaattaatatctgatggctctccatgagttgcccatctagtatgaccgataccaagtgttccttcagctttgccttgtcctaaattatcagttaagttagtaagacgacctttatgcttttcgatacttactttaccatcattaacaactgcaatacccgctgaatcatatcctctatactctaactttgataatccatctactaaaaaagattttgctgatctacttcctaaatatccaactattccgcacatatttattcttcctctcttttttcatataatatttaattttaattcttcttttaacttcattcctagcacaattataaaagggcatagtaatcctagaaattaaaattaaaacaaaggttttaacaccagactgaatttgtcctgtgaatcacttcacagttttaccagtcgtttacggtagtgcgataccgtggggcacccgccgaagtttcgatactccccaacctcgtcgacgtaaatgaaactccaaatcttcgatttggatagttgaatttactcagcgaacgaacgtgagtcgagtttcctttaaaaagatttcattagctattcgcgtagcttatatcaaagcttactattaactaaattccttttataaaaaccaaccctgtaaaaattcactttcaactaaattccacttagtcctggcgctttttattgattttaagaatttctttcttctccattcatcacctctgttttctttatttatgcctctttgactattttatcatattattttcaattgtctatatttatatatatattttattattactttttggttacaaaatcatcttcagataattaattattaatatgttaaatcactaaaaattattaataaaatatttaaggtggataattatccaccttaaatgagctttctatattgctaaaacgtcattatatgccttttctatcttttctaataagtcattatcatcgatattagcaacttctgctatagctccttttacgcccttttcttttattaattcttgtagttttacactttgtgtatcttcttgattattgtagtgtaatgctgcacctactcctagtaataaattgtcaacgcttaagtcaaatcctctagcagtcattaatggttttattaatctgtcgctatcacttaattttctaagtggttctcttccaactcttgatacatcatcttttaagtaaggatttttgaatcttccaataatcttatctatatatttgaagtgagcttctttatcaaatttatgcttttctactaagcccattccactttctgtcattgctttcttaacaacattatatattttttcatcagctatactttcatctattgttccataaccttttaaatttcctatatatgctgtaattgcatgaccagtatttaatgtgaatagctttctttctatataagccattaaattatctgctaaattcattccttcaattgctggaatacttcctttgaatgctttttcttcaacattccattcatagaatttttcaactactacatctagaatattttcactcttaactggtggaacaattctatctacagagcaatctgggaatccaacaaattcttctaaataagctttttcttcttcgcttaggcatttttcaacttctgcttttaattgagaacttgcttttattgcattttcacatgcaattatatttaatggtgttttgattcctgcttcttttctaagttgtattcctttagctattgttggagctattcttggtaatacaacaagacctactgctgttgttataatttcagcttcttttatttcatctaaaatttcatcgtttatagaaataactccgcttatgttttcaactactatttcttcacaatttacatccattacatgtattgtgtattttttatcttcattgattttatcaattacttctttatttacatcagcaaatactacgtgatatcctgcttttgaaagtaatgcacctatgaatcctcttcctatgtttcctgcaccgaattgaattgctttcatattacatttctccttcttctataatctccattatttcttctggtgtctttgcttttctaagtctttcaacattttcttcatattgaatagttaaagctatctttgataatatctccatatgttcatcgccttttcctgctattcctattactatataagcagtattgccttcaccaaaatctacaccattaggatattgagctataactattcctgtttcaagtatttctttcttgtattcattcataccatgaggaatagcaacaccatttcccatgtaagttgtaacttcttcttctctagctttcattccctctatataattgtctttaacgtatcccccattaattaaaagtttaccaactctttctatcgccttgtccttagattctgacgcaacatttaatactattccttcttttactaaaattcctttttccattagtcttcctcctcgttatttataatattaattaaataatctctaatatctatagtgttacttagtcttagcatttcaacaaattctttcttttctattaatgaaacacttatttttccaagaatcttaagtatataattactttcagtatttcttgcaaacattactataaaggtatctacatcttctgtggaaaatcctatactcttcatagataaaggtttatttattctatacactcctacaaatggagcagttattgtatcacttcttgtgtgtataagggctacatgagttcccggaattacaacatttccattttcctctctcttaaatataagatcccttattacttctttatctgttccaatatcaatcttgtgaatatcatctactatataatttattagattaataaatgaatcactatctgatttttttagctgaaaattcttaaccatcgtattggctaattcatattcgtgatttgtcactgtattgtcttttgtttgagcaaataattctagttctctttcattattactagctttaaagttagaaataaaattacttatattctctatatctacttcagtcataaagtgagaaacaacaatcaggttatgctttgttttcaagttcacaggaacagtggataggatcaaatcatatttatttttatcaattatactattaatgtcatgtaaggatactacatcaataacattgatttcattaaatatcgactttactttactacaaagtattcttgcagtacctatgccacttggacataaaacaagtgcttttatattctttgacatcgcctgttgcttttgtactgcaacagcaatatgcattgttatatatccaacctcttctggaggaatcttaaaattgtacctagagaatattaatctgcaagtattttttataattttatataactctgaataatgttcttttatttcattaatcaaaggatttataactttcaatcctaaatttaacatataaaatgtttgtttaaaatgctgagtcaaatcccttattagctgctcatctttagtaatatctacatatatttttgttgatatttcctctgtaacctctttagcaatattctcataattaatgtctgattctataagatgcttattgttaaaaaagtatttgtaatcacttaaatataaacataagtaaacaagttcatcttcacatatatctatattattcttttgcagaacactacctaaatattgtatttttttatattcctctaaagataatatactatttttaatctcttgaggtaaatatataatttctccattctttgtcttttttatagatagcaatacttggataaacaaactaaagtatttgacatcatttcctttaagataatcaaaatctatatcttttaatatatcctttactaattggatagcctcattcccaaaaacaatgttaaacaaagttttaactatcggatcaaccttttcatcataaagaaatgctattaaatcttcaaaaggtttaaaatcaaagaatagctccactaatgcatttctcttattccactctgacccttgaatacttatcccatagctacgttttctaatcacgcataaattcttagatattagtctttcttcaatgttgtctatatcaaggcttatacttcccattacaacattgaacttatgacaaaagtacgaagcttttagtggctcattactaactaataattcacatatgataactatttgtctctgttctttacttaatagccaaggaatcggaaccatatctaatgatttctttatctcctctatattttctttattacctgaaatacttaaattcatattttcgtcattaaatatagttatactattcttcttcaatcttttattaatagaagaaagttctcttaaaatagttctctcacttatgtcaagatctttatgaagccgttttatattaaaagttccttcatttaatactgtacttaatatgaattgttgtctaggcgttaaattattcataatatctcacctgatttatctattattttgtatatattgatagactgatcatatctataacaattaattttaacttcaagtagaatcttcagatgtcattagattttgaatttattaaattcttttaaacatagattttcctattaaagaagataccatacacacatcttaaataaaactactaatttaaagttaataacccgttgtatcataaacgttatcatcagagctaccagtttatccaaagttcaagctggaagtcactttgtctaaataaagttttatataataaaacctcctatttaattactataaattattgcttctttcaatatatatattaccctatatgaaacatcctttcaattcaaacaagttcaaaactgtgatacatttctaatgacaaatttaaagtttgactatcatccactctcatctctattatttatcaaatttaaaaatggcattggtaaatcagtccgtttaccaatgcctgtaagttatattactaaattctactctagttaataatatcttattattttaatgtgttaataaactcatcatacttagaacgatctaagaagttcttaactgtaattatattagcagttctagctgattttcttgctctttcaactaagttttcttgagtgaatacaacatctgcttcttgtggaatgctatcaactgatgaatgcttaactccaacatcagtaattccagcatcttttaatgcttttttaagaatagattctcccattgcagaagatcccatacctgcatcacaagcaaaaactattaatttaacatctgcttttgatacattagccgcagtttctgaagcttttgcgcctttactttctgctttcatatctttcatcttagcttgagcttcatcaatgtcttgttctccattatcttttgatgccttaagaattattgaaccaactaagaacgatacaattgcacctacaacaactcctgctaaaacagatacatagctaccttttggtgtcatagcaagtactgcaaatatactacctggtgaagctggtgctgcaagtccagcatgagttaatacaaaagttaaatctgcacatattccaccagctattgctgctaatattaatgctggtttcattaaaatgtaagggaaatatatttcatgtattcctccaaggaagtgaattattatagctcctggagctgattgttttgcatttcctttaccatagaaagtgtaagctaaaagtataccaagacctggacctggatttgcttcaagtaagaagaatattgacttaccaacttcttgtgcttgttgtattccaagtggagataatattccatgattaattgcattattcaagaataatactttagctggttcaatgaatatatctattagaggtaaaagtcccatatttgtaactatagtagctaaacttcctaatgtgtttgaaaaagctgtaactactggttcaatacaagtataacctataagtgctacgattcctccaaaaattccagatgagaagttattaacaagcatttcaaaacctgttggaacttttccttctaggaattggtcaacttttttaattacaaatccaccgaatggtcccatgatcattgctcctaagaacattgggatagaagcaccaattacaactcctgttgttgctattgcaccaactactgctcctctttgaccatataccatcttaccacctgtatatccaataagtaatggtaataagtaacttaacatagggcctaccattttaccgaaatattcatttggaatccatcctgttggaatgaataaagctgtaattaaaccccaagcaataaatgcaccaatgttaggtaataccataccgcttaaaaaactacctaatctttgcacgcttcctttaagagacgatttgttagtttccataataaaacctccatctatttttatttatataatttattattagttctttcatttactatcttaaactatgaagaataccttttcaatttaaacaacttcaaatttgagttacgttttcaatgacaaatttaaagttaatgttaaactgttgaaaatacatggttatagcctaaaatgatcgaaaagaaagcatacttttattatctttacaaaacaaaaaaatatacttagtaagtgtttttaacctattaagtatattaaatattacaataatccttatctattgtcttcaatttatcaatagtttataatttactaatataccacctcaggaaggatttgttttaatatggaaaaagaaaatttatttaaagttgcagattccttaattaactttttatggattattcaaagtaatatattcaaagtacaagatatatctaaaatttttcaatcattacatgaaaataataaacaatgctgctctgatttttctattcctccttcacacgccagagttatattctatctttttcacagtaattcatctcctatttctcaaatagcagataatataggtatatcaaaatctaatatgactccaattatagacaaccttattaattatgaattagttaatagatatccagatcctaatgatagaaggattcttagagttgaactaacaccaaaagcttatgatttactgaattctcttcgtaatgccatctgtagctctttcgctgaaaaaatttcttctctttctgatgatgaagtaattacgttagatgattccataataaaccttataaatatattaaaaaaattaaaataacacttacctaatcacttgcttacataaaggatattttttaaattataatatctcgattaattctatttctttcatttcaccaaatttaatcgaattattcctctaatcagaagcattaaaaaaggatgattatataaatcaccctttttcatcaacttttatatataacttatctctgtaattttttatttctccattgcttctctaaatgactctattaaatcatctatatcttctaaccctacggatactcttatcaatgtatctgttattccaagctcttctctttcttcttttggaattgaagcatgactcatcttagctggatatgaaactatagtttcaacactacccaagctaacagctaccgctacattctttacattatttaaaaatatttttgttctttcaaatgttttgaatttaaatgataatacagcacctgctccatcggcttgttctaaatgtagttctcttccctccatagaaggtaatccaagataatataccttttcaacttcttctcttgattcaagccattctgctagcttttgagcacttttttgaagtgcatctagtctaacttttaatgttttgatacctctaaccaaaagccacgagtcttgtggtccaagtactgccccaaaagtattttgtatttgatacaccctatctcccaattcctttgttttagttacaacaagacctgctataacatcactatgccctccaagaaatttagttgcactgtgaacaacaatatctactcctagttcaataggtctttgcaggtatggtgacataaatgtattatccactatagttattgccccattttctttagctaatttgctagctgttcttaaatctataacttttagcagcggatttgaaggtgtctctaaataaagccctttagtattttctttaaatgctttttctatctcttcaatatttgatgcatctacaaaagtgaattctatattgaatcttgagaataattttgtagtagctctatatgtccccccatatacatctccacatattataatatgatctcctgcagagaatatcgataatactgagcaaatagctgccattcctgatgcaaatgcaaatccgcactcaccaccttcaagttctgcaattaatttctctactacatctctagttggattacctgatcttgcataatcatattttccgaagttttctatatcaaattggtgaaatgttgatgtctgatatattggagtgcttactgaccctgttgtaggatctatatccccacttgcatgtattaatttagttccaaaattcatatttaacgccccattctattttttattataaattctattttcctatagcactttctagatcatttaacaaatcttctacattttctattcctactgatagcctaagtagatactcatctactccaagtctttgcttaatttcttccggtatctctgaatgtgtttgagtaaatggatatgttattagtgtctccactccccctaagctctctgcaaatcttattactttaactctttctaaaatcttggcaactaattctttttcttttactctaaacgataatgttgccccaaaacctgtcgattgtttcttatttaattcatatccttcaaaaccttctagacccacgtaatacaccttttctactttaggattaccttctaaaaacttagctatcttaagtgtattctcttgtgacctttccaaccttatatgtaaagtctttataccccttaaaattaaccatgaatcaaagggagataaggtcgctcctgttgacatgtgaattcttcttaatttttctaatatttcttcatcatttgctactatgaaccctgcaagtaaatcatgatgcccacctaaaaactttgttccactgtgaactactaaatctgctcctagttctagtggtctttgatagtacggagttaagaaagtattatccacaattaacagtaacttatttgcttttgttatttctgcaactgcttttatatctgttactttcatcatagggttagatggagtttctataagtattgcctttgtattttcttttatagaattcaatatatttttagtaattgtagtatcaacaaaggtagcttctaatccaaaatccctaaaaatatcatcaaacaatctatatgtcccaccatataaatcatcagataagattatatgatctccagacttaaataaatgtatacaggctgtaattgctgcaactcctgaagaaaaccctatcgctgattttccgccttctaaaacagctaatgttttttcagcttcttctctagttggattttgagctcttgcataatcatatcctgtgctattattaaggccatgatgtttaaatgtggcagactgatatattggaaaacttatagcacctgtttctttatctccacctgatactccactgactgcaattgtttcaaaagatttttttaaagtcattattttgcctccttaaatttgctttgcttaatgaattacttattgctaataccagagataatattaataaaaaaagccacttccaaaacaagaagtgactttatagtcatattataagttctacaaaaacttaattcctctcatttttcaagatattctcttgcaggatttagcaccaacgaaaaaatttatatataaaatctttcaggttgccgggcttcaaagggccagtccctccaccgctcttaataagattaacttatccagatatttttttgttaatactaattatacatagttacagaaacttgtcaacaattattagtaaaaatatcgactttctatgtaattaaattatgaaagtttcattcctaccttaagacttcttctaaataaaaaacagatagatattttaattcttaataaaatatctatcttcacaaatttaaccttcataacactaatcatattttgcatatacattttaaataatacaattcattctttatagaatatataatttttactattcactagtttaaggtgaacttcgatgaattaaacttctttaggatatatgtgttttattttttatctactactttttcatactgcttactcatatcttaaggcttcaatcggatcaaggctagccgcttttttagctggataatatccaaagaacacaccaatcgccattgaaaaagtaaagcttattaaaattgttggaatagatattgatattggtgattttaatactatacatgcaattattcccatcccaattccaagtattataccaattgttccaccaatggtgcatattataactgattcaattataaattgcatctttatgtgactacttttagcaccgagagcctttcttgttcctatctctcttgttctctctgtaacagatacgagcattatattcattactcctattcctcctacaagtaatgctatagctgcaattacagatatccccatagatatcataccaagcactgatgttatttctgccgcatcagcttcattattctgaaccattaatgtccaattcttattattcttgtacatcttattcccatacttttgcatatcgctaactaatttccctttgtctatccccattttagggactacagtaaaatactcaaagtttttatttttttgtagtgctttttcagttgttatagggatatataaagaagttcttctgtccttttctgatgtagaaccttcacccattccaaataatgatgaattttcatattgatatacaccagctataacatatgtctgaatatcatcatttgcatagactttaatttctttacctaacggatcagttcttcccttaaagatattattaacaagcttatcagaaactatagcgactttagaatttgctttaacatccctatcagtgataaatcttccactaattagtttcaagtttttaacctgtttgtatccttcatttactcctgtggtgcttacatttgcataagaatatccgtcttttacttttccttgtcctaattgttcctgtacacttatattattaattttatctttaaatacttcattaaatgaatttatctgttccattgttataagatcactatcttctggctgtttactagtcccattcccactagcagttccgtcttctttttttaccgctataccaatatctatattatttgcacccattttatccatttgagatgatacggtggatgtaattgcagttccaatagaaacaatccctataacagatgatattcctattataattccgagcatagttaataacgaacgcattttgcttgattttatacctgctatcgcaagtgctatattctcttttataaacataacttttcaccattttgaaaccttctagtatatttgtcgttatgttcttctgatactattttcccatccttcaatgttatgattctctctgtttctcctgcaagttcataattatgagttataaagacaattgtcttcttctccatttcatgtaccttatgaaataaatccataactagcctaccagttgatgaatcaagtgctcctgttggttcatcagcaagtattatgcttggatcatttgcaagtgcacgtgcaattgccactctctgtttctgtccacctgataattcatttggaagatgcttcattctatctttcattccaacaagttctagaagcttttctgcccgttcttttctctcctgctttcccattccataataaagcattggtaactcaacatttttcaaagctgaactcctcggtattaagttataagtttgaaacacaaatcctattttcttatttctaacttctgataatccattatctgttttttcaccaacatttgttccacttaaaatatatgttccagatgttggtctatcaagtgctcctataatattcattaaagtactttttcctgaccctgacgcaccaactattgatacaaattcgccctcttttattgttatatctatattcttgagaatatctaattgattgggagttccaatataaaagctttttacgatgtttctcatttctattatattatcattcaaaaaactcaccttccacttattcgaattttttctccaactttatgagttgaagggtcatcaattatgataattccatctgatattcctccacctgaaatttctacactgaaatcagattcaagtcctgtatctactggtaactctttaattatatattcatttggtttttcactgcttttttctgcaacatatatactcttggtatctccactttcaactatgctattagatgcaactgtataaatatcagacttttcatttgtaataatatttatccttgcactcattcctaccttcatattctcatttgtatcatccactttaatttttgcctcaaaacctgcatctgagcttgctccttgagactgactttgtgaattttcagattgtgcttgaggtacagatccccctccctttttagcagctggactaacactttccacttctcctgcaaaggtttcatcccctgttgcatctgtttttatttctgctctctgtcctactttaacattagctatgtcgacttccttaattggcacagttatttctatattatctaaattttcgatctgaaataaaactccatttcctgaatttccaacaacagcatttacatttgtaactatcccatcacttgtagccttaatagtgcaatcatctagctgctgtttttgcttctcaatcgcaattctctggcttttattattatagtttgtttgtgctgtttcatagtcacttttagccttattaagagcttggtcaactttaaccttagcattttcaagagctgtttttgccttctcataatctgatttagcagtgtcataatctatcttaatcttatttaagtcgctctcagaaattgcttgagcgttaaataaggctttattcttatcatatattttcgctttatcatcaagagtaatttgtgctaaacttagtgtttcttctgcatttttaatatctgcatttgaattgttattatataaattcaattcatcattatattccttttgagctgaatcaagctgtgtcttagcattagcttcagttgcatctgctgtagctatagcctgttcaatatctttttctaatccatttgaatctagtaccgctagaacatctcctgctttaaccttatctccctcttttacttttaactcttggactggattgttcaaggtactgtatatgttagttgattctttactttttatttctcccaaaacattaacactatttacaatcttccccttacaaagaactgtactctttacttgcggagctgacttaggcataagaaactttcctattatgatagctccaattattataaatattgtacatattaatactacttttttgcttggcttcttttttagtttcatccccttaagacttatgcccttaggttttaactttttcacatctaatttcggcatttttaaaacttccccctattcttaacagcctttttatccatgtaatagtaattaactaacattgtcatatatatgttactctttaagcatcattaattcttacactacccttacaaacttccatatattgaatttatgtaactttatcaatctaatattcatcagtatatcactaatgctttaacataacccttaacaaaacattaatttttccttaaataaaagcttaatataaatcagttcctgtcatatcacttatataataacctaagtttaattattcttatattgataaaccttacatttatctttcaattctgcaacaataatatggctaaagacatattataaataattccacttaacctaaaggctgcttcgaagtaattatttcaaagcagcctttcatatttattaacaataaaaactctatttaattttaaaaaactcatctttaatattcccatttagcgtcggcgataattcatttaatttccctaatatttcagccctattctcaccacctgctaaagttggaatataatcatttttatcatttcttgaagaaatcattgctggaattactttatactcaagactagataatttatcatcttcaatattaactttaatttgaagtatgaaagttcttttatctgatggattggaatttcctccgaagcaaaagtttcccatagaatatgctataaatttccccttataatcttccatactttcaattacatgtggatgagaaccaataaccgcatcagctccattatctatagaaaatctagctaaacttttttgaacatcatctggttcatattttctctctactccccaatgaaagtatggaatgacaacttctgctccccgctttcttaactcactaatatcgcttattattttagattttaaattattagaatattcccaacctgtataccctaaaaatccaaattttattccttgaatatcctttaagattttatatccttcaccacatatatcaatattcttttcttttaaagtattaatcgtatcatttatcccttgctttccataatcatagatatgattatttgctatcgtaacaccttctattgatccgctagtaagaatgtcaacgtattccttaggtcctttaaaattataaaatacttctccatctttatgtgctttatctttggaatctgtaaatgtagtttctaaattcactagtgtatagtcatctttactaaatacgctcgatacattttgcataaaataagaataattctttccactgcctataaacgctgctggtaggctaccatcataagggaatttagtgtcagtccctaaagtgaagtcccctgcaaaagaaataacaatcgttttctttattggttctttgagttgattagttttataattatcatcaattgacttatcagtttctccatttactttatcgttagctgtattttttttattgcttaatccttctctatactttaaatagattaaagaactagttaagactaatatagttaccaatataaaagttatatattttaaataatcactttttttcttcttatctcttatgtatgtttctccatgacttatcttagagtttttatcattcatatatagacccctaactttctagttttgagttatctttatacaaatactaacatattatacattttgattctatattttatatgcaataatccctctaaatccaaacaatatttgttcgcaaaagaattcttttatctaaaatgtattcctaatatttaataaaacctaataagtgttgataaagttttagctctcatcaattacttgcaattatataaattcaaatatcacattttgttatttaaatgattctctttttactaacttagtatctataatatagtgatttatcgccgtatcattattttctagaaaatctatcaaaatttttgtagcataataccctagttcttctgacttaatgtcaactgatgataatgatggtacttgaagctccgctaatggactattattaaatcccaccacatctatattattaatttttctctcattgagtaccttaagcgtaccaaatgctaatacgtcatcctctgctattatggctgtaggagtaatattttctaacaatttaattgttccatctattccttcctgttcattaaaatcatccataatcgcaaaatttttatcgtgtattgaaattccgttaatttcgcatgcaactttaaatcctttaaatctatcttttgtaacattccattccttctttgcgcctagaaaagcaattgatttatgtcctttctttacaagttcatttactaaattgtaagtagcctgaaaattgtcattatcaacccatagcaaattttctgattcttccggtcttcctattactacaaatgggaattgtgtttccttaagatatttaatacttctatcatcagttcttgcacgtaataagcatattccatcaactaagttacttgttatgaaattatttatatattccaattcagctttttcatcctcactaaatgcatatgtaatataatactttttgttttgagcgtatttgctcattcccttcatagcttgaataaaaaacgtattagttatcaagtcttgagcttcattaggtaaaaccacacctaatattctgcttttcttatttgccaggctcctagctatcgcatttggcttgtatttcaatctctttatcgcatctctaactctttccttagtttcttcacttatctgtgaactatctgatataactctcgatacagttgatggagatacattcgcttctcttgctacttcctttattgtaactttcataacttactcctattctcaataataaattacttataaagtttactaacataaaaacatcttaatcacattctaatatactatctttttaggaataatcgcttaatgacagtaaaaacttatatatgtcacgctttataactattttcctttaataattttaatattaacatacttaaaataatgttacaattgccatatatatggttttattaaacagcaatcaaataatctttcttgctattactaggaatcataaattgaggcacgctatctaattaacaaataaatacgtagttaatctccaccataattaatgagtatatattattgtagagattatctttcatataaattatcactatcctttacttttgctatagtacctcctaattatcacaccttccataagttctagtgatctgatgaattttttctgctaattgatctgtcaatgcatctttccttactctccaacgccaattattccccaatgttgaaggcaaattaattctggcttcatttcccaaattcaagaaatcttgcatttgtgccatggaaatattcgcgatactgctccaagcacccctaataaatccccagttatacccctcttctttatttagacctaaatacgttattgctctttgaacttcttctttaggtgctgttttttcaatccatcctcttacagtatcattatcatgtgtaccagtataaactataaagttcttttcatagttatgaggtaaaaaaggatttgagctatctgaatcaaatccaaatgtcaatatcttcattccaggaaaccctgtatcatttctaagctttattgtttcttcagtaagtgtacctagatcttctgcaattatattaacttcaccaagctcatctttaattgcattgaaaacttttattccagggcctttaacccattcaccattttctgctgttagatctccataaggaatagaccaatatgattcaaatcctttaaaatgatctattctaagtacatcatataagttcaaactttgtcttatgcgatcaacccaccatttatagtccgttttccccatatagcaccaatcatagatcggatttccccataattgtcctgtggcagcaaatatatccggtggacatccagcaacttttaatggttttagtgtatttttattaagtaagaatgcttcaggattcccccatacatcagcactgtcctctgccacatatataggcatatctcctattatttcaattcccaaattattaatataggcttttaaattattccaatgtttatagaactcatattgcaaaaacttccaaaatcctatttcatcttctaataagattttatacctatttattgcctctggttctcttaacctaatgtcttcatcccattcataccagctcttcaaatcaaaatgtttttttattgacatatacaatgcataatcatcaagccaataggcctcagcttcttgaaacttaattaaatccttatcttgtcttaatttaaatttttcgtatgctatttttaatacccttaatttttctttaaaaatcaaaccataatctatatcctctgaactttccccaaagttcactgaataataatcgctctcatctaaaaatccatcctgtcttaaaatatcaaaatctataaaatatggattcccagcaaatgccgagaaagattgatatggtgaatctccaaaacttgtaggccctagcggcagtatctgccaatacttctgacccgccttttttagaaaatctccaaatttatatgcttctttaccaaatgtccctattccatactttcctggcagagaagcaatgtgcattattataccactacttctattcatatattcctcctaatttccaacgtttgttttaaatttatttgtataactaatctctattctcttcatgcttaaagcaatcgcttgcgcaaagaaacatattaatctacattaataagaatatagtaaccatagccaatatacgctctcttaatgactattttatagatccttgaacaatacctgcaatgatatgcttttgaacaaagaaatagaatatgattattggaattattgctaaaattaatgctgccattgctaattcccattgttttgaaaatgctccgaagaaattgttcatagctaatggtatagtatttatctttccgtttatagttaaaaatggtagcaaaaagtcattccatatccatatgctatttaaaactgcaactgtaacagtaattggctttaataatggcaatagaattttcatatatgtctgccatttgctgcatccatctatagttgccgcttcttcgacttcttttggtactcctttaatgaaaccatgatataagaatatgctcatgctaaccccaaaccctatgtacataaaaataagcccatagtgtgttcctagcatttgaaatggtccgaactggatttttgccatccattttacaagcggtatcattactgcttgaaatggaacaatcattcccgaagtgaatatataaaatattatcttactctttcttgaccgatcccttactagcatccatgaagccattgatgaaaaaagaattattagtaccacacttcctatagttattatcatagaatttgcaaatgaacttattacactcatttttttcatagcatctaaataattctgaaaattccatgtatcaggaagaccagttgtgtttgaaaaaatctctcttcttgtcttaaatgaatttataagcatcaagtaaaatggtgtcatatatgctatcaatagtaaccatgaaaatacttctaatagttttaatctgccagtataactatctagtgtctttagctttttatttgctttaactttttctatattattaacaactttacttggctccattatacctctacctcctttttcttattaaagtaaacttgagttaaagaaatagtagttactagtacaaagaatataatagcttttgcttgtcctattcccatattgttcacaataaacgcttcattgtaaatatttaatgctaacatttcagtggttttcattggtgtaagtgaaaaatttaaatcaaataacttaaatgaatttgctaaagttaagaataaacaaattgtgaccgcttgtctaaccataggtattgttatatttttaaatgtatgccatccattagctccatcaatatgcgctgcttctattaagtcagtcggaacattttcaagggctgccacataaataaccattatatatccagcatattgccatgtcgaaacgattagcattgctagcattgccgtagttggagcttgcaaaagtgatgttgaaagtgttgcacttcccaatgctttaccaactcctgtaaatactgaattaaacataaattgccatataaaacctaaaattaatcctcctattaagtttggcataaagaatccggttcttaagaaactactagtttttaattttctagttactatatacgctagtccaaaccctattatatttatagttattacactcacaattgtatataacactgttatctttagagaatatataaattgtacatctttaaagattcctgtataattttttattccaacaaaatcataatgaggattagcaccattccaatttgtaaatgtataatatatacctattataaacggaattattacaaccattgtcatagcaaataaagctggtccaacaaaaatccaaaaatctttaatatctcgtgatttcttactcatacacttactcctttcttaataatagttagctctatcttataatttaaaatacttatacaaaattcatgaggaggtattaatcccctcatgaataaatcttatctaatattatttagcttttgtagcatcttgaattccttgtaacatatctttcttcgcttgtggccccatatctgtattaataaatttagagaataaaggcgctaagctattcttgttaaatccatctggtagattagtgaatgcccaaggaagagtctttccttctttgttatattcagaaattgatttatttaattcattatcactttcaactgtaaagtttgtaaatgctggaatcatattcatatccttaactaatgcctcttgacctgtttgacttgtaaccatccaatctaagaattctttagcttctttattaattttagaatctttatttactacccaatacattggaacacctactggaatagatccactcatttttggatcattattaattgcaagtggtgcaaatcccatatggaacttcttatttggatcttctagcttttgtaaatccccagcaacccagttaccttgatgtaagaatgcagtctttccaagtgcaaagttaccaacttgagtactataatctatagtgtctagattctttcctccaccatatttacaaagtaattcaactaagttcatccagtcattaaattgcttattattaactatatctgctttgcctgcaagatagtcctttgtaaattgagccggattatcttgagttgcaagtggtatattaaatgtatgattaccagtaacccagaattcttttgttgtataagaaacaacattatcaagtcctaattcagcttttttactatctaatgtctcaaacgctgctttcaatttatcaaaagaatctaaagatttgggattgataccagccttgtccaaaatatctttattatataacaagccatacccttctgttgctgctggcattccatatacttttccgtcgatagttactgtatctagcgttcctttaacagcatttttaacccagccttgatcgcttaaatcatcaattttatgtttccaagtttcataatccccagctccttgaatcataaatatatctggttccgtacccttttgaaattctgcctttaacgatgctccataatcagctccaccgccaactgaagtaacttcgacttttacgcctttttccttttcatatttcttagcaagttcttgaagtgcatcattaatttcaacctttaattgatatactttaattgtttttccacttccagcatcgcttgaactttgcgaacttgctcctgatgagcttccgcatccaaccatagtaccagccaataatgtagaagctaaaattgttgataatatttgttttgttttcatttaaatacccctccattaaaattttgtttaacattctaaatgattttcaagaataccaaacatatatttatataacacatacccaaaaatttatttaagcatgtatgttaatcactttctttcgcaaacgattgcgaaaattttaaaaaaatgtagtctttttagcattccaagctatccagaccctgtttgttaaccttttcttaagtagatctacttcttaatgatataagtatatcaactaaagaaaacttttacaaataatattttcctttatttttgattaaatttaatgacttttccgtgttttattaccatttactcaattatagacctctttataaaaacggttgcatagattcttctcatttatttatacctattttcggctttatacgtacctattaatgctaacttatcttttcttgttaacttttttatttcatattctcttttcattgcatcttttctattttcaaacacctcataatatactaatttaactggccctcttccccttgtatactttgctccacatccatccgaatgcatttggattctttttcttaagttatttgtccatcctgtataaagtgttctatctgaacattctacaatatacacataattcatttcgctctccaattccaaaaaacttatattaatctatatatattttataatgcaaataatcataagacaatttatattttcattgtcctatgattattaacaatttaatagtttcacacaatataatattatttaaaatcggtttatacttaaaacatatgctaaatttcttttatctcatttatcttagatttataatcttctatttttttaattgttcccaaaaaatacattgctaaagttatctaaattcaaatcttcatattttcttaaaaatggcattaatctttctaatattatgttaatagagttttccgaatccgattctatatttagtggcagtacaggctcatgcagcgataatcttaacaatagccagccatctccattttctttatcgcaatttatctttattccttcataatttttaggttcaatagtccatccattcacatgatctacatatttcttcaagccttctattatcatttctccatatgatttaaaatcttccctctttatgtttattctcatatccatactttccttaggatattttaaattttctataaggcttgatatttcttttccttcatcttttaacttggccatcttaattagtattttggctattaaatatgccccatcatctaaaaagtaattttcttttaaagctgcgtgtcctgatgtttctattgctaagcagcttaactttccttctttatttaaccttttagattcatttattacattcttatatcctcttttaaatctatgatggataccacctaaactagttataaaatctgaaagtccagtagaggttactgaatctgtaacgataattgaatttggattttcctctagcactattgaagatatcaatgctataagtgcatttttatttatttcttttccatcactactaactatagccgctctgtctacatctgtatcaaaaattattcctaaatcagctttattattaagtactgcttcttttatagaattcatagcttcttcattttctggattaggaatatggttaggaaaatttccatctggttctgtaaattgacttccctcaacactcgcacctaatttctctagaactttatatgcaaaaaaaccacctgctccgtttcctgcatctacaattattttggttccctctaaaggtctctcataatttgtttttgaatttacattctttcgtatcttatcaactaatatatttgaataaacatctatgaaatagattgtttcaactagccctttagtagtacatttcttttctgctaagttagaacattcaattatgttttcaatatcttctttttcgcatccaccttctttagtaaaaaacttcaatccattatagtaatacggaagatgacttgctgttatcattacagctccatcgcatgaataattctctaatatagttgtcataaacattgcaggagtcgtacatattccacaatcataaacattgcaaccagaatcaactaaagcttctattaatgattttttcaattctggtccagataaccttgaatccatgccaactgctatttttatatttttattactgagtcctttagtttttttaagccactctacaaaaccaaatcccacattattcactaaattaggtgtaagatttttagctccttcatattctatagctattccccttatatcagttccactttgcagttttttaagttcttgtagcataataataactcccctctaaaacaaaaattcatgataagacacctactgcaataaatctaatatatttaataaacactaataaatactttttcactattgaatgttacttacttattttcaatttcttccactaaagcaagtctttctgaatgacgtccaccttgaaattttgaatttatccaagtgtctacaattgtaagtgctaatccttctcctgttactctttcacctaaacataaaacatttgtattattatgctctcttgtcattttagctgagaagcaatctccaacgacggctgctcttattcctttatgtttattagctgcaattgacattccaattcctgtcccacaacataatattcccaaatcgcattctttagatatcactgctttagaaaccttaattgcatattcaggataatttacactttcactgctattagttccaaaatcctcaacctctatatttttagatataagatgcttttttatagctccttttaaattaatgccaccatgatcgcaacctaatgcaattttcattcgcttcatcttctttctatatttattaattgaaacttatgctgactagtagtataattgatgttaaattaacaggagaatactcgcaatattctcctgatattttaattattcttaatgagttatggggtattgttgatgcctattattttttgattaaatgaatcaatattgtctgataagttttctctaaataatgatgaacctataacaatatctctagctcctgacttaatcacatcttctatattatctaaatttattcctccatctacctgaacagtaaatccataattgttctcgcttttaatatcattaagtttccttatcttctccaaactaaacggaatgaacgtttgtcccccaaatcctggttctacagacattactaaaactctatctagaagagaataaacgtgttctaaacaacttattggtgtggctggatttaaagctactcccgcttttatcccaaaactttttagataatgtatacttttatacaagtgagttgcaacttctgaatgtatagtaatactattcgcgcctgcttccactaaagcttcaacaaattcatctggatttgtgaccattaaatgaacatcaaactcagcatcggttaactttcttaaagaagccacttgatctaatcctatggatatattaggaacataatgcccatccataatgtcaatatggatgacttgaatatttttttcgttgaatactttaaaatcatctgaataattacatacatttgctgataatagtgatggcgaaattattgtttccatctacaatcccccattcttacttcatttattactttattttgacttataataatgacttaactgtttcaactatatgtgctgctgttaaattatatttttctaataaaacttcagcatttcctgatcttccaaattcgtcatttattccaattcttttaatctttactggatgttcttcaatcaataactctgcgactgttgaacccaatccacctattatgctatgttcttctacagttacaatctttcctattcttttcgcaatatcaacaattaattcattatcaaaaggttttatagttgatatatttacaactgttgcgtttattccttgctcactcaactttttagctgcttctaatgcctttgctaccatcaatcctgttgcaactacagctatatcttcaccgtttaataagacttctccttttccaattttgaactcatagtcttcactgtgtatatctggagttgctgatcttcctaatcttatatatactggtccatagtattccttcgcagcaaatattgctttttctgcctcaatagcatctgctggattcaatacaaccatattaggtatacttctcattaaagaaatatcttcaatagcttgatgacttcctccatcttcaccaactgttattcctgcatgagttgctactatcttaacatttaaatttggatatgccactgagtttcttatttgctcaaatgcccttcctgctgcaaacatagcaaatgtacttgcaaatggtatttttccacatgtagcaaggcctgctgcagttccaatcatatccccttcagctattcccatatcgaaatatctttctggtgcatgttttttaaattctatacttttagttgcctttcctaaatcagcttctaatactacaacatttctgtcttctgataatttctttagagcttttccataagcttctcttgttgctattcccattatcttacgcctccttctaattcagctaacgctttcatagtttgttcttcatttggcgctgatccgtgccatgcaacgttattttccataaatgaaacgccttttccttttaccgtattacaaactatcattgttggcttaccttttgtagctgctgcttcatctattgccttaactatttcttcaaaacaatgcccatttatagttaaaacattccatccaaatgatctaaacttttcgtcaacatgacctatactcattacttcatcattagagccatctatttgcaatccattaagatcaagaaaagtagttaaattatcaagcttatagtgagctgaactcattgccgcttcccatatttgaccttcttgtacttccccatctccaagtattgcataaactctgtaagaactttcatctaactttcctgctaaagccattccatttgctgttgagagcccttgtcctagtgaacctgtagacatatcaacacctattatttttttcatgtctggatgtccttgtaatttagattcgtactttcttaatcctaaaagttcttccttagaaaaatatcctctttctgctaaagtagcatatagcgctggtgctgaatgtccctttgataatacaaatctatctctatttggattcttaggattttgaggatctatattcatcttttcaaaatataatacagtaagaatatctgtaattgataaggaaccacctggatgccccgattttgctgctgatacacttttaataatgcttattcttatattgttcgctatcttttttaaattttcgttcacaaataacacttccttctaagtaattaagatcttattactacttttaattctgtaccttccatagctgcctctattccagatctccaatccttaagatctacaatttttgttatcaatgcttctgggtcaactttttttgcttccattaactctagtgattttatccaagaacttggtttttgtgatctagatccaacgtatttaatctctctttgaataatagcttcttggtctaatggatttttaatatttgcaaataatcctacttgaacaaattcaccttttttctttataagtcttagtccctgatttacagctggaactgctccagagcaatcaaacgctctattaacaccatatccattagtcttttccattactattttttctaaatcttcttgtaatgaatcaacaatcacatcaacacctaattttttaccaaactctaatctttctttgtcctttgtaactccacttaaaattactttagcaccttgtgacttaactacttgagctagaagtaatcctattggtcctggtcctaatattaaaactacatcatctttatctatagtcgttttctctaaagcagcatgtacacaacatgcaagtggttcagttaatgaggctgccaaaaaactaacattatcaggtaatacatgtacactttcttctcgtgatagcacatattctgcaaaactaccatttacttgagttccaataccctttcttgaaggacataaattataatctttactcttacagtaatcacatgttccacaagtttcaaatgtagtctcacttgttactctatctcctattttaatttccttaacttcttcccctacttcaactactgttcccgaaaactcatgtcccaaaactacaggtgtctttatatttccatattcacctttaaatgaatgtaaatctgatccgcatattccactatactctacttttattttcacaaagtttttagtagcttttggctcctgcatatctaatagttccatttgatcatatcctggatttgtttttgttaatgctttcattattgctaacctcctgctttaaataaatctacaattatttattctattaaattttttattacttcgttgttatccaaataaaggttgaactaattgtgataattttagtactaaccagttaagcaaattaccacctgtatctatgttagatactaatgccacaccttctggcatcttaaattgagctgaagccaacatttgtgtaaatactggtgcaaaatctgtagccatatataatgaaatggccattactattgttcctgttataactgagtgcacgatatttccttttcttgatcctactataaatgctacacagaaaggaattgttgctaaatcagcaaatggtaatactttatttcctggcaatattacagctaaaaagattgtaattggtactaaaattagtgctgttgatataactgctggatgcccaactgcaactgcagcatctaatccaatataaagttctctatctccgtatttcttttgtaaaaactctcttgctgcttctgaaactggtattagaccttccattattatcttaaccattcttggcattagaatcataactgctcccattgttattcccatattaaatgtcttaccaatgtcatatcctgctaaaattcctagtacccaacctataactattcccatcatcataggttcaccaaatataccaaatttcttttgaatagtgtcaggatcagcttttattttgtttaatcccggaattttttcaactaagtaacccactaaaaatcctaaaggtgcgaaagatgctgttgaggctgtaggtagtgatacaccttctaagtcataaaaacttcctatcattggggcagttttatctgctataaataaagttactacttctaagagaactgcacagaagattgcgaaaaaccaattgttagttaatatataccctgttgctccagctgctataaagtgccaataattccaaatgtctatattcaaagtctttgttgttttagttaatatcattaatatattaacgcccatgattataggtattaaaattgctgctactggggaagcccaagcccctgcagctgcagacggccatcccgtatctagtactgttaattttaatccaaatctttcaaccatttgttgtgctgctggccctagacttccagtaagtaaattaattactaaatttatgccaacaaacccaattccaattgtaaaaccagcttttaatgctttcttcaatcctataccaaaaactaatcctattatcagaatagcaattggtaaaattacagttggtccaagacctaggacatattgtataactcccattaaattattcatgacatttttcctccctttattttatttatttaaattaccttcttaacatcattaaaaaggtaatttatagctttgttatcttaaatagcttaatattttttcatctaacttatcagtacctattccactaatataagctgtagcctttatagctggaattttaaattctcttggcaaaatagttgttgaaattattaaatccgcatgatcttctaatgacccaacttctgctattttgcattgagttacagttgcatcaatattattttcctttactaatctttccactctgtcacaaaccactgttgatgttgctattccagccccacatgccactaaaatacgttttttcataattaattcctccctttatacactttgtaatttattcaaaatattttcaatgtcttcttgactagttgctcttataatttgttttactagatcctctctttgtataagatccattagctctcttaacacttctaattgactatgaggtttgttcagtcctaacataaatactaaatttactttttcctcctgtttctcatcttccattagtttaaattgtattggattttctggtacaactattgcaataaattcctttttgacatgaactgcatcagtatgaggtattgcaacactataattatttagttttattcctgttggaaaaatgctttcccttgatattaagccatctaaaaaacttgattctacatatccatatttaaaggcttcatcatgcatcaccttgaacaattcatttctgtctttgcatggtaaatttacttttattaatttttcattaataaacttaactagttccattattacttctcctttcactacactattttttacttaacctttatggctatttatatcgcaagactcatgccaaacttttggaatattttgattttatgaaaacaatttctttacctctttttcagattgagctatacgcacgttgtttactaagtttttttctctaaccatataaaacaatttttttatctcttctctattgtcttctttaagtgccaacataaaaactatatctaccgctgtttcgttatcccattggattggtttatttagttttgctataactatagctggtctaattatattttcaggaagtccatggggaatagctacctctttattaaacacactatttcccattgcttctcttttatatagatttaacataaacttattatttacaaatcccttttcttcaagtaactctgccattttatctataacttcttctttaaatacacagtctaagtttaataaaataaattcttcatatattagcttgtttagcctctcataaactaacatttccttattatcaaactgtatctccataagcttgattaatctattaattccacttccatttaatatactgtcataatctataaatggtatgtttgcaatatttacttttattgttccgcatactgccacaatatcgtattcacttgacatcttagtaatttcagcctccacatctttttcacgaataagccccattgcaaaaatttctatactatggttagctgttttcagatgactttcaaggtatttctttatacttagcgagtttccttccccagtcaaacaaacagttattattgcttttttcttattctttttacctgctatttctgacttaaacgtaccattatattctttaacttcctttagcatttcaactatatcttccaagcttgctccctctatagaggcttttctaacagcttctaatgccaataacgtgtcaactctagctagactcatagttttgattccagtcctctcttccactattgttgagaacattcccaatgaccccatatctacaagtagtaaacatccccgtccttcgtctatttcctgaactaactcaatagttctttctataccgctttctggagattcatctaaagctatttctatcccaactgtatcttccacccccaacaattgattaacaatgtctgcaattccacaggctacatgtccatgagttattatgattactctaacctttggttttacattaaacacatctgaacagaatttctttatataaattgctatatacgttgtttcttccttcggaatttttaactttgtggatttttctatcattattctgattttctctgcaattttcatttcttgtaccatggttgccttttccatatgaatatttgattttgttataacttttccattcattactctttcaattgtaaaattaatatggattgctaaggcaataaaaaaactattatttataaatttgtatttttccctcactaattcaagaattccttctgttatgtttataacttctggtcttactattgtttttaactcattaatatttaaaagtttagttatctttttattatcaataattttacctaacttattctcaactttttctaaaagaatttcatccatctcttcattttttattccttctaattcaagcttcttaaattgttcctctatatagtgatatatctcgttttcgtttacatatttgtatatttcatctttatttttttgttcattctttatatctatatataagtcatctattccaagatttttaacttgcttcttctctttctggccttctgaaagtgcactcttgattgaaagactcaaatcttctatatctataacaacttcatctgtattcttaaacatatattttacataactcttcgcacatataacttgaatatcgctctttaattgacctatattagctttacagttatacatcatcaagcacgttaatacatcctttttaaccaatagatttctattaattcttctggcctctcttgttaaaaacattactatgacctctaatctttcagataacggtctttccgttaatttaggtaattcaataagtacaggtatccttcttctaaaagtcaatagtagattagattctgggttttctgtagtcgccgccagtataagaacgtttacttttcgttcaacattagtttcacctaaccttctatactttcctttatctataagataaaacaatatctcttgcccttccgatggaagtctatgaatttcatctaaaaataaaattcccccatttgctttttcaactaatccttctttatctgaattagccccagtatatgcgcctttaattactccaaacaactgggctatgagcaaatttggattttctgcatagtctgcgcaattaaatactatgaaaggggcatctttagactttactccacttaatacagaaaactcatacatacattccgccaactcacttttcccaactccagagcccccataaattaaggtgtgaagtccattcggtggatataatatagccgcttttgctaggtctatcttatttctaagactccctctatatcctataagtttttgaaagctttcctcatttttattattatctttttctttaatcactagagtttcatttggaagtgtagactcatttccccctttgatctcttgaataacgtctttaatatttttacttataatactacgtgaaatattatagcctctctccatcattagttctgttacttttcgttccgataaatttatattttttttcaatatttctcttagatctgctaatagcagttcttttcttctatccctagaatctggaatatttagttcatttcttttttgtattacttttagccttggtatagataagaattctgcaagttcttgatcggtataaggattctttttatcctcactattaataagttctattaatctttgcatgtaatccctccacgatatactataattattttgcaccttagtgattatgatgtgtttattttcatactttttattccataatatcttatagtagcaatatctatgccacggtacaatttgtgccaaatagaaatgtcattttttctattctccccctttataattcaatttcctaaaaatacaaaaaatcgcgtaaccgaaaacattgtaaactacgcgattttttatactgatatggtacactattttacttttcttgtatatcatttttacttcatttttggatgtaatatattctcatttttattaattctatagcatataagtttattgtatatactttttaaacatttagttgatcataataccacttaaattacttttctcatataaaatatttctgaattaataacatgttctaattcgtggcccctgcatttctattactttcaatagttatgcacagattctgctaaactataaattcataaaaaaagaaagtagcagattcaaaatctgctaccctaatacatataattaaatattagtctactttagccgtatcaatccagctcatcattcctcttaattccttaccaactttttcaattggatgttctgcttccattcttcttcttgcattaaatcctggtctattagtttggttttctaacaaccaattcttagcaaatgtaccatcttgaatttcagtaagaactttcttcatttctttcttagtttcatctgtgatgattcttctaccaatttggtaatctccatattcagcagtatctgaaattgaatatctcatcatgcttaatccaccttgatataataaatcaacaattaatttcatttcatgcatacattcaaagtaagcattttctggagcataacctgcttctactaaagtttcaaagccagctttgataagttctgaaactccgccacaaagaactgcttgttctccgaataaatctgtttctgtttcatctttaaatgtagtttcaagaactcctgctcttgctcctccaattccattagcatatgctaatgcatattgtttagcttttcctgttgcatcctgatgtacagctattaaacaaggtactccagcaccttcagtatatgttcttcttactaaatgccctggacctttaggcgcaaccataaatacatcaacgtatgaaggtggaaccacttgaccgaagtgtatattaaatccatgagcaaaaactaatgcatttccttcttctaagtttggagcaatttcttcattatatatttttgcttgcttttcatctggtaataaaatcatgattaaatctgctgcttttgccgcatctgcaacagttgcaacttgcaatcctgctgcttctgctttagcccaagatttacttccgttatacaatccaacaacaacatctactccactttcatgaagatttaacgcatgtgcatgcccttggctaccatatcctattatagcaactttctttcctcttaataaatttaaatctgtgtctttttcgtaatacatttttggcattttaatgacctcctagttaatattaatatcttcttcacttattatttggttaattggcgcaccaggtgcaaccataggaaaaacttttttatcactgtttattagataatctataagaactggaccttctgaatccagagcttttctaagtatatcgtctatttcatctacttgagttattctaaatgctttagctccaaaagcttcagcaagcttaacataatctgtaggtctatctaaagttgtctcagaatatcttccttcgtagaaaaagtcttgccattgccttaccattcctaaacaattgttattcataataacttgaattaatggaagattgtttttaacagcagtaactaattcattgcagttcattccaaaacttccatctcctgcaatattaaatactcttttatcaaatctgcctatctgagctccaattgctgctccaagaccatatcccatagttccaagtccacctgatgttataaatgttctttcacttttaaaattgaaatattgagcagtccacatttgatgttgcccaacttcagtagaaattataaaacttccgtcatttaatttattcaacctatcaaagaacaattccggagtcaagtcacagtatggcactaatttattattctcttttaaattatttatagtatccaaccattcgtcatttttcttttcatcaattattggtattaattgattcagtgccacctttaaatctcctactatacatgtatcgacttttatatttttatttatttctgctggatcaacatctatttgtaatatctttgcattttttatatgattttgattacttataactctatcactaaatctagctcccagagttattaataaatcacatttagttgcagcaatatttgatgcttttgttccatgcattcctatcataccagtgtataattcatgatcatttggaaactcagacatacacataagcgatgttgatacaggacaatttatcttttccgcaaattttattaattcagatgttgctccagatatacctatacctccgcctgcatatataagaggtctcttgctttgatttattaacccaacagcttcctgtaatgatttttctgtaatatgctctgattttctaattacctctttaggaattattttattatattgagttttttcagcagtaatatcttttggaatatctatcaataccggacccggtctaccttcctgagctatataaaaggcttcccttattacgtcctgaagttcattaatatcccttacaatataattatgttttgttataggcattgtaattccagttatatcaacctcttgaaaactatcctttccaagtaatggctttgccacatttcccgtaatagcaaccattggaattgaatccatatatgcagtagcaatacctgttactaagttggtagctccaggtcctgaagttgcaagacaaactccaacttttccagtggcccttgcatatccatcagccgcatgtgatgctccctgctcatgacaagtaagaacatgacgaattttatccttatatttgtataactcatcatatatatttaataccgccccacctggatatccaaatatagtctctaccccttcatcaagcaatgactttattaatatttcagcccccgtcaataacattttattcactcctttgcttataaaatgatctctgtttgataactagcaatgtataaattgatttagattctattttgttgcctctaatttctcgcgaactagatttcccatttcaattgttccaactttcttcttaccttcagtcattatatctccagttctatatccatcttcaagaactgctaaaactgcattttcaatagattttgcttcttcctccaatgaaaaactatacctaagcatcattgctgctgaaagaatagttgctaacggattagcaattccttgtcctgcgatatcaggagcacttccatgaattggttcatacattccaagagttccttccccaagcgatgctgaaggtaacatacctattgaacctgtaaccatacttgcttcatctgataatatatctccaaatatatttgaagttacaattacatcaaattgatttggatcttttactaactgcatagcagtattatcaacatacaaatgatttacttcaacttctggataatccttagccatctcgttaactacacttctccaaagtctagaactttctaatatgttagctttatctacacttgtaagtttcttatttcttttcattgctgtttcaaatcctattttagcaattctagttatttcatttacattatatctttcagtgtcataagcactctttactccatctacttcttccaatcctctttctccaaagtaaattccacctgttaattctctaactatgcagatatctatcccatctttaacaatgctatctttaagtggtgattcattttttagtggagcatatagtactgctggtcttaaattacaataaagatttaatgcaccccttaatcctagtagcgcttgctctggtcttattttagcagtaggatcatcccacttagggcctccaacagctccgagtagaactgcatcactttttttacatgcttctaaagttgcttctggaagcggagttccttctttatcaatagcgcatccacctgctaatacatattcatattcaaatctatgcccaaatttatctccaataacttttaaaacctttattgtttcatctatcacttctgggccaattccatcccctggtattacagctatattacatttcattatgataatccccctcttataattgcctatttcttattgctttttaatcaaaatttaattattaattctagttattagtatccttctcttaagaaaatatattagtttaatttgattcttcttttaataatcagtttttctatctatttcttatatatccaatcaatccatcattatcgatgattttttgcataaattcagggaatgcttccccttgatactcttggctcttagttaaatttttaataagacctgttgagaaatcaacttctaattcatctcctgcatcaatattttttacagcttcatcacattctaaaattggtaacccaatattgattgcatttctataaaatattcttgcgaaagttgatgcaataacgcagctaacccctgctgttttaatcgctaaaggtgcatgttctcttgaagaaccacatccaaaattcttatttgcaacaattatatctccactctttacatttttaacgaaatccacatctatatcttccatacaatgtgcagcaagttcgttagcatccgaagtgtttaaatatcttgctggaattattacgtctgtatctacattatcaccatatttgaatactttaccttttacactcattactaaatacctcctacactaattcaggatcagttatttttccggttaaagcagacgctgctgccactgctggacttgctagatatacttctgactcaacatgccccattcttcctacaaaatttctatttgttgtcgatacacatctttcacctttagctaagattcccatatgtccacctaaacatggtccacaagtcggtgttgaaaatgcagctccagcctctaccaagtcagtaactattccttcttttattgcttgtaaataaattttttgagttccagggataactatacatctgatgccctttttaactttctttccttttaagatatctctagccattcttaaatctgaaatcctaccatttgtgcatgatccaattacaacctgatcaatagctacatccccagtattatcaattgttcttgtattgtctggtaagtgaggaaatgaaactgttggtcttaattcacttaaatcaatttcaaatactttatcatattctgcatcttcgtcagcttcataaaccttccattctctagaagcatgatcttttaaatattcttctgttttatcatcaactgggaaaattccattctttccaccagcctctattgccatatttgccattgtaaatctatcatccattgaaagatattgtaagccatcacctacaaattccattgatttatatagagcaccgtcaacaccaatcattccgattatgtgtaagattatatccttgccacttatccattttgctggtttattcttaagtacgaattttaaagcagatggaaccttaaaccaacactttcctgtagccataccagctgccatatcagttgatcctattcctgttgaaaaagccccaagtgctccataagtacatgtgtgtgaatcagctcctataacaacatctccagcaactactagacctttttcaggaagtaagcaatgttcaattcccatttctcctacttcaaagaaattttctatctccatattttgagcaaattctctaatatatttaacttgttctgctgcctttatgtctttgttaggggtaaagtgatctggtactatagcaatttggcttttgctaaatactttatctgttccaaacttcttaaattcatttacagcaactggcgttgtaatatcatttcctaatactaaatcaagatttgcttcaattaattgtccagcttttacagcttccaatcccgcatgagctgctaagattttttgagtcattgtcattcccatgttttaatcccccttaaaaatatgcttttacttttctttcaatatcttttattaatttatattctattgaatctactagagctatccaactagcttgaattacatcccgagataccccaacagtactccaactttcaatcccatctgttgattcaattaatactcttacctttgcctcagttgcactttctgaatccaaaactctaactttataatccactaatcttgcctgttttaattctggataaaaaacttctagtgctttcctaatagccttatctaaagcattcactggtccttcgccttctgctgctgtcatctcattttgtccatcaactgtaatgtttattactgctgttgatgagaactcctctgatccatagggttgttcaccaatgatcttaaaatgattcaatttaaagaacggtttgtactttccaataatttttcttataactaattcaactgttccttctgctccttcaaactgatacccatcatattctagttctttcaatctatctgtaatcttttgaactgatttatcatccttagatatattaggaaatatcttttgtatttcctgtaaaattgtacttttgccacttacctcagatactaaaaagcgcctcttattccctaccaattctggctctatatgttcatatgactttggtgatttagttactgcatctatatgcattccgcctttatgagcaaacgctgaatttcctacaaatggatcttcatctgataaagtgatattacaaatttcagcaatatacctagatgtttttgttagatttactagctcgttatcatttaaaactttatatccaagctttagttttaatgtaggtattattgtgcttaaattagcattcccgcatctttctcctattccaataaaagttccttgaatctgactcgctcctgcctccactgccatgatcgaatttgcaactgccatccccatatcgtcatgactatgaattccaagctcaaccttcactgtttcttttatggttttagttatgctatatatctcttgaggtaaagcccctccgttagtgtcacatagtacaactacttttgcccctgcttcttctgctgcctttaaagttgccatcgcatactctttgttggctttatatccatcataaaaatgttctgcatcaaatattacttctttccccttaacacacaaatactcaattgtgtcttttatcatatttacattttcacttaaagaagtttttataatatctgttacttgaaagtcccatgacttcccgaataccacaattgtgtctgcccctgatgacagtaagtcttttagatttttatcatcttctacgttaattttaggtcttcgtgtagatccaaatgctacgacctttgcgttcttaagttccacatccttaagccttttaaagaattccatatcttttggatttgatcctggattaccagcttcaatgtaatcaactttcatctcatccaaaacttttactattttaattttatcttctaatgaaaatgaaattccttgaccttgggctccatctcttagagtagaatcaaatattttcacctgattctgagccatatatgattatcccccttttcattttattgccttattgcttttagattatctttatttaatgtacattaataagattcaatggaatttcttatagttttttcccctctttgtagtgctgtcacacctgttctaaccaattcttctattccatactcctccatcaggtttattaatgctgatattttattttcatccccagttaattctatcgttaaagtgtctgtagacaggtcaattatcttgcttctaaaaatatttacagtttcatttattgcggctctgttttctgcacttgcctttaccttaattagcaccaattccctataaacagagtcatcagctttaaagtttataacccttataacatcttctaatttatttagctgcttcttaacctgttctaatacattctcgtctcccataagtgtaattgtcattctcgaaattgaaggatcttcagttctaccaacagttaaactatcgatattgtatcctcttcttgaaaacaatccactgactctactcaaaacaccagatgaattctttactaagacagataatacatgcttctccattgccttccccccttaaaaatggttaaaaaaatccacccttaatgatataaatcataagaagtgggataatattccgccttacataatatcactaggttctaacaaacccttgcatataacggatgcacaccggatatcttttactcaagaaacgttgttcctctttctggattctgctcaggagtgataattatagagctaaagtatcgattctcaccagccatcgactctctgcaacttatctactaaataattttctccatctcagcattttatagcttaaggacctatttgattttcctgttagactaaattgtactctcggtttttattgttgtcaacattttaattatatatttttcattatcatttttttatatatttacaatatatgaaaattaactatttatcatttttttatgcacttttttaactatatatcaatacactaagacttaatttaattatattaatctttatagtagcttaaattaacaatttaaataagctcacttttattgtttttttaatttggagtactacatcctgctaacatttgttccataatcatccatatattcaacttcttgaatgtttgctaaaactgtatctaaactataatcatatatgttaaaatttatttttgcttcacataactttgaaattatctcttccttctcatcttcaaaaactaactctttattaatttcttcaatgaatgacgctgttttatatatttcgcatttcgctccctcttcggcacctaactgtgtaaatacgttgtacctatattcatctccacctatttcagtagcatcattataaccatccttatgaaaaacatcatcaagacgcaattcataatacatattaatatatgcttttactccttctatatcattaaatcccttgcaattaccggttggcatcactactagatattcattataaggttctttgtccatataaatgcctcctttatcaacgtattattattttatgtattaatctatttatccccttattgttcatttgttattcataaaaaattatatgtaaaaagacaaactttcaagcaactttataaacttatagcaattttaaattagttttatctattttgggtaaataaataaaaaaggaactcatttaatagagttcctcttaacaaaattatatatactttatttaattaattatatttcttctcgattaagtttgctaaattatgagccatttcatctatctcagcttgattttctccttcaagcattactcttactagcggttcagttccagatggtcttataagtactcttccaacaccatttaaagcttcttctatttttcttatttcgttttgtatttcatcatctgtcaaatataaatcttttttatcgtttggtattgttgcattagctaaaacttgtggtaattccttcattattgaacataattcagataatgctttttcctttttcttaactatccctgcaatttgaagcgctgttactaatccatctccagtcgaattataatctaagaatataacatgacctgattgttctccacctaagacatatttgtttttaaccatttcttctaaaacatatctatctccaacagcagtcttaacaatgtttattttttcatttttgcatgcaatatctaatccaagattgctcattacagttacaactaatgtatcatcttttaacttaccaagttcctttaaatattttgcacataacattagtataaaatcaccatttattaaattacctttttcatcaacagctaaacatctatctgcatctccatcaaaggcaaaacctaaatcgcatttctttttaattacatattccattaattcttctggatgcgtagatccacaattttcatttatgtttgttccgtctggattgtcattaattacaaatacatcagcgcctagttctctaaacgcttttactgatgatttatatgcagctccattggcacaatctaatgctatctttaatcccttcaagctataaggtatagtgtttttagcaaattctatataatcatctaatgctgacacttcaattgtctctctgcccaaatctgtgcctgttggacttggaactccttcaaaatcactttcaatgactctttgaatctcatcttccaattcatccgaaagcttgtatcctttatcgttaaagaacttaatcccattatattctactggattatgtgatgcagaaatcataacacccgcatctgctccatatttccttgttaagtatgcaacagctggtgtaggtactactccaagcactattgcttcagctccaactgataatattcctgctattaatgctgattctaacatatctcctgatattcttgtatcttttgccactaatattttaggcttatgagctccttctgttaatacatatgctcctgctcttccaagatcatacgcaattcttgctgttaattctgtatttgcaactcctctaactccatcagttccaaacattctacccataattttacctcacttttttattctgttatagtcactcaattactataatatacttaatcacttacaatggataatattatttgcaatttcttcagtgcctaccttaaatagtataatatttttaacacgtatttacaatcttctctttctgttataatattactattttacaatcaattacacataagaataatatttttagaatcagcatctatttagtctatattttcatcttttaatctttctaaaactaaattatatccatcactgccataattcaaacatctattaactctactaattgttgcagtgctagctccagttatttcagctatttctgaataagtctttttacatttaagcagctttgctacatgtaatctttgtgctaatgatttaacttcatttattgtcgctacatcttcaaagaatttataacattcatcgatatttttaagttctaaaattgatttaaaaaataaatctaattctttactttttagctttgactctaaagaacccactttatcacctcttgtaatacttattttctctttaattataaccatctaaagcttactttacaactttaatatacgaaagcatatattaatatgaattacataaaattcataaaacaaagaagaagcttattataaaataaaatttataatacacttcttctttaattaaatttataatattctaattatagatcttcaacattactttctggatttatgccacttatcgcgtccaatcccttaatatttaaatccttgtatatactttttgtaggtactagccaaacttctccagtacctctatatacattgaccataccttctccactaactgcagttcctataattgatttagatgatttctccactgagaattcaatgtttcctgtccttaagatagcaaagtttccatctacctttaaagtatcgttaattaatatacatttaaatatttcactttctggaactggaaccttaagaacaactattccgctaccttctatcctagtttgatacagtccctcattccctagaaaagctgacgatacatttttttgcattgttgcatcaatttctataccttcttcacatgcataaaacatattatctcccacaactatttcatcatcctctagctctattaatgcaaaatgaccaaaagaaggctctaaaaatatttctccagtcccactataagtaggcctaaatatactttctcctattaatttacttgatattatctttttgccaagtcccaacaacccacctgatttatttgttatttgaatcttccctttcatatagctcaaagaacctggttcaagtgttaccgaactatcttctagcaatattctcacttgttttaattttataccactctttttcattatgttaagtccaaaagcagtttgaacatcagtcgctccgtctaaattctcatattccaatatttgaaactttgattcacattccatttcagataacatatttaatttgttagtaaactttagtgaacttctcataaaattacccctaccttataataagctgtttcatgtttttaattgtcctttttctctaactcctctaaaagagtgaatactctcttattgagcacaggatgcataagatatggtgctatttcacttaatggttttaatacaaattctctctcatgcattcttggatgtggaagaatcaccttttcatttgaagaaaccactgaatcatatataataatatccagatcaatagttctaggtccccattttatagtcctctttctatctagatttgcttcgattccaagtagtacatccataagttcttctgcttctaatatagtttctatttccacaacaccatttaaaaaatcttcctgttctaagtatccccatggttttgttttaataaacgatgactttcttattatttcaatatttttttctgcagatattttatttattgcgtcctctaaatattgttctttattcccaatattagatcctaaacttatatatgctttgtgccttcttctttcaatcattatttctacagtatctaaatgtttttttataggggcccaaggcttttttaggaacaccttaacaccttctattatcttatattcattaagaataaaatcagctaaatttaaagttgctgtttctataagctcatagttctttcttttaaattcatcttctattttttcacacaattcaccataatgaactgttttagttaaatctccagtttttcctgctaattttagatctatatctagttcaaaagataaaatgaacttttgacctaatcttttttcctcttcgaaaactccatgaaagccaaataactctaattctcttatatacatcttatccaaaactcatccatcctatcttcttacgattatatcagtcatctttgctgctcttgaattttcaagcacatcatgaactcttacaaaatcacaagcatctttcattattccaataaccgttgttgcaactgtcccctctattctttcctctacaggcaaattaagagctaatcctatcatagactttctggaagtgccaagcaatatcggatatcccaactctttgattctttctaagttattcatagcttctaaattttgttcataggtctttccgaaacctatacctggatctagtattatattttcatcttttactccagcatccttagcaatattaatacattctttcaaatcatttaatatatcttccattaaatttttatactctgtattatctctattatgcattagacaacaaggtacattatattttgccgcaacttttgccatatctttatcttttttaaatccccatatatcattaataaggttcgcaccagcttctattgcttgctctgcaactttagctttgtatgtatctattgatactggtatatcaaaatcttcttttatagcttttattataggtacaactcttgaaatttcttcttcttcacttactatctcatatcccggtcttgtagattcccctcctacatctattatgtcagctccgttatctatcatttctttcacatgttttacagcaacatcaatgtcattaaattttcctccatctgagaaagaatctggcgtaaaatttaatattcccataatatatgttctttcccctatattaaattccttacttcctattttcattgatttatagctccttttaataatatattttaaaatttttcttttcatctccccaattacattcatcaatagacttacagctaatgcatagccgtgagagtttatctgctctatacatgagctgtgcaaagttttcactctttttatctctgtgtcctagtattccttgttttataatttcaatttcttcctcattatatctgtaattatgtaaaatttcttttgaaatctcccatgatgatatttcatgaggtgttccattttcatactgaagcgactttcctatatcatggagaattgcagtagtatatataatttctttgttaaatcctagactttcttcgagatttattaattgtgctattcgtgctacatctaaaaagtgttttaaattatgcttgcaaaattttctatctttttcaaactttttatttctttttaaataatatatatattctgtgtcattcaaaatacaattaaatctatccatatcataccccaattaaacttattctttactaaatatcattacgattattttattatatcatttggccacagtttagcgatatatatatgcgaattttatgtaaaaaaatacacctagaaaatatctctaggtgcatctttacgtctagtaaaccttagcttgttcttctccatcaagtactcttatagcaccttgagctagagcaagtaattcatcttctccaggataaactgtaactggggctatccattcaacttttgctttaaggtctggaacaagtgttggtgagtatgcaattcctccggtaaaaataatttgatcaactttaccttctaatacaactgacatttctccgattgcttttgaaatttgataaacaaatgctttgtatattgattcacattctttatctccttcttccatcttatcaataacaccttttacatcatttgtgtttagataaccaacaaatccaccttttcctacagccttgccatatacttctgcttcactatattttccactaaaacacattttaactaaatcaccaattggaactgatccagctctttctggtgagaatgggccatctccatctaatgcattatttacatcgacaactttcccatgattgtgagcaccaactgaaacgcctccacccatatgtacaactacaagatttaggttttcatatccttgtccactttcttttccatatcttttagctaccgctttttgatttaaagcatggaatttactttttcttggtagttctggtactccagatagtcttgctacatctgctaactcatctgtaacaactggatctactataaatgatggaatatttaattcatctccaattgacttggcaattattccgccaaggttagaagcatgaggtccttgaactccaacttttaaatcttcaaccattgcatcatttactgcatatgttccaccttcaactggtctaagcattccacctctaccaacaatagcacttagagtctttatatcaaaattcttttctttaagaacatttaatataacttcttttctaaattcaaattgatcatatattgtatcatatctctttatttcttcatttgtgtgtctcaaagtttcttcaaatagttccttttctccttcgtaaacaccaatctttgttgatgttgaacctggattgattattaatagcttatatgacattctgaatcccccttaaatttaatgcattctatacagtcataatgcataattttcagaagaaattattatagaatctaatagtgcattgcaaattccatataaatctctccattaattatgcattaattattatggattgatttattacttatttcttgctgcaactaatgctgcaagagcaattgaattaactttagtttcgaatgaatctgctcttgaagttaaaattactggtgctgatgtacctactaaaagtccaccatttcttgatttagagaaatatgttaatgttttatacattacatttgctgcttctatatttggtaataataatatatcagctttacctgctactgatcctgtaacacctttatgatgagctgcttcttctgatattgcattatctaaggcaaaaggtccatcaattacgcatcctttaatttgccccctgtcactcattttagctaacaatgctgcatcaactgttgattgcatacttgtatttacaacttcaactgggcatataggtgctactcttggaacatctattccacatgcatgagcaactacaactgcattatttatcattccaactttatccttaaattctggatatgtattaaatgctgcatcagttaaaaataacagtctatcccaaccttccacatcaaacacagctacatgggacattaattttcctgttctaagaccaacctctttgtttaatacgcttcttaggaatgttgcagtatcaactagacctttcattaacatatctgcatgaccactagaaactaattttactgcttctaatgttgctttctttggatctttaatatccattatttcataatcagataagtccaagtttattttctttgcgatttcatggatttgttgtttatcaccaaccaatattgcttgtgcgatgttattttctgtagcttcttttatagcctctaatactggttcatcttgtgctacggctacagccactttttttgttggaacttcctttaatcttgataataactcatcaaagtttttactcattttttgcacctctactttaataatttttaacttttatatatgattaatttaattgtttgttaaatttatatcaatcaatgctatgaatatttctttataccttattgtaacaaaaaaatattggaaatgttgaattttcagaatattatttttattatattattaattttatatattcatttttataagatttcacaacacgaacgtaatataatatatcttcctcatcttctgaaaagattatactaattctattcatgttacttataatcttattttggtaaatcgaatttttcaattatatgttcggcaacctttatcccatcaacagccgctgatattataccacctgcaaatcctgccccttctccagttggataaagtccgcatacatttatactttcaagtgaagcatttctattcaatctaactggtgctgatgttcttgtctcaattcccgttaaaattgcatcttctcttgcatacccttttatctttttatcaaaatttataattccttctttaagagcctctacaacataatcaggtaaacattcttttaattccctgaattcataccctgcagtataactcgggatgacctcacccaacttagttgacactctatctttcataaagtctcctactaattgaacaggtgctttataatttccaccacctagcttaaatgctaaactttcataatgcctttgaaattccattcctctaaggggtgagcttcctttaaaatcttctggagagacagtcaccactagtgctgaattcgcattatctaaatcccttgcgtgataactcataccattagacacaagtcttccttcttctgatgctgccgcaaccactactccaccagggcacatgcaaaatgaatatacacctctttttagcttttcactttgatatgtaagtctataatctgccgcatgtaatttaggatgattatgattgttgccatattggttaacatttattaattcttgtggatgttcaatccttacccctattgcaaatgcctttgcatccattgatacattttctctatataacatttcatatgtatctcttgaactatgtccgatagctagcactaaagcctcacatgtaatattctttccattgacaactatgctctctaactttccatctttatatgttattttctctaacttagaattaaagttaacctctcctccaagtctctttatttcttctctgatattcttaaccacaccttttaaaagatctgttccaacatgagctttgctctcatatttaatttctgctggcgcccccgcctttattagttcatcaagaacaaatgaacacctgtgatctttaattcttgtagttaattttccatcagaaaatgcacctgctcctccttctccaaattgaacatttgattctaaattaagacgtccatccttccaaaacttttccacagtttcagttcttttatctacatcttccccacgttcatacacaattggtttatatccataccttgctaatgttaatgctgcaaaaattcctgctggcccgaatcctacaactactggtcttgctttaatttcttctgtaccactttttattgactcaatttctctaatttcttcaaaacttatatccttatcatgtattcttgatagtaacattttctcctttttacaaaatacattaacgctaaagcttacttttatatcattcttttttcttgcatctatacttctcttgattatatctaatctgctaatatcttcttttgacatattaagctttttacatatttttttctctaaaacatttaaatcatcgtctaaactcagatttatattatttattcttatagccacagacttatcaccatatcctttcaacaaacaatctataattatatatctattcaatcaaacttcatattttatttattatttcccatcctaccttactgcaaactaattcaaagaaattatatcataaaaaatcacagtattaacaaattaattaatactgtgattttattattatccttttttctttattgttacactaacagttccaacatctgatactgttacattattagcattaacaagtgttgcctgaggtgtgtaatcaaaagtaccttcttcttttacattagctaaatctagtattacacttatattttgtgaacttatcttatctaatgcttcttgtgtacctgataattttacattggatactaaactttgatttgtaaccaaaaatatatcacttaaattcttgtactgaacattacattctatatttttagttgtattctcttccttctttaatttaaatttagccttaattgatgcttctccatcacttatcgaaataccttctggcaagttaagtttgacatcgacttcactatcaggctgcaatgacgacatgtccacggcctctgtatctattgactccaacttatttaaaacctgactatcgcctaatacagttacattatttttacttaattcatacccatctaaaacaaatccttgaggtacatttcccgtagtctttacattaactggcactgtcttcccattcgtaaccgtaattgatagctttgcagtttttatattagattcaatattgctaactgcatttccaaatgagtctataaattgtatattataatcaccttgcttatttttatctacatctttttcttcgccagtcagaatagcttcagtaaccttatctacggaacttttcccccctgttattgttacggtattaggatttatattttgctctttttcataaatattctctttataagttacttttacttttgagcttatcgtaagttccttttgagtcaattcctctaggttaacttttatacctaacatcccattattctttatagttatattttcaggataactcgttatttggactggtattgtattttcccctactttaagtgcataagccgacatatcagctacaatcttaaaatcttctttcttcacctttaatatttcacttgatggcccctctaattttaaatccaccgtaaatggctgtttatttacaattgcgaattttgaatctactaaggaatcctcattagttaattctactggtattccttttaattcataagtcctaagtgggttctcaacattcgagatatatagccacagaaccactgataacagtaaacaaataattttaacaattaacgttccgttttcacttttatccatgacctcaccttctctcccgccgttttaactcttttctggtttctattttctactaccttcgttagtataagctttaatctatctttatcataacctcttgtaatttttccattgatcgctagcgatactacaccagtttcttcagatacgattataactagcgcatcagatacttctgataaacctatcgctgccctatgccttgttcctaatttcttatttatagaattattactagtaagcggtaaaacgcatccagatgccaaaattctattatttcttattattgttgctccatcatgtagaggagtattaacaacaaatatattttccaaaagattcgaggtgattttggcatctaatactgttcctgcaccaattaattcatttaaacctgtactttgctccattacaattagagctcctgttttgctttccgctaagttttgtacagcaattgtaatttcattaatcatagtattaaaatcttctctattattaagataatgatcatcgaaagcacttcttcccaaatgttctaaagcccttctaatctccggttgaaaaattataactacagataataccccgatggttaatgtcttatttaatataaaatataacatatctaactttaataaataactgattggaataagtgctataattaatactattccctttaataattgttctgcccttgtttcctttattaacatatatcctttataaaatatataggacactactagtatatctaatatggaccatatcgatatattagaaaagctttttattaacattgttaaaagttcttgcaaatttcttctcacctctttttctctcacaataaaattatacaacaaatactatgatattagatataaagagaattattattttcttactttttaattatttttatagtaattttttattactattaattaattatagtttatatcgttataaaatcctataaatgattatacgaataaatagtgtatataattactttctttggcaataatattatttgttgcattataccgaaggaggttttttatgaaaaagacatatagtatttttgtaactgcgttaatactatatctttccgttattaatatgaatccagcattcgcatctaatttagctggatctcatggtgaaattaagactacttatgaaaatccaaaaatgaaagtaaactacttaagtgctaatataaacaattctcagtctgatgagaaaaacaacgaagttttagaagttttcaaacatgatactcaacaattatatataacgggtgaagatatagatctaatggcaaaacttgtatctgctgaaagtggtggtgaaccatatgctggaaaggttgctgtagcttctgtagtattaaatcgtactattgatcctcattttccaaatactattagagaagttatattccaaaaaaatgccttttcatgcgttaagaatggtaaaataactgctaatccagatcaagattgctataatgcagtatacgatgcgattaggggcgctgatccaacaaatgatgccttatttttctataatccggctaccgcaacatgtcattggatgaaagaaacacaaaaagtaaacgaaaaaattatagggcatcacacttttttcaaagtaaaagtgtagcctctatatattgatttaaaaataatgggttatatcaaataaaaatgatataacccatctcttattgcaattacttttcaaaaaatccttttacaatcacttctccattctccatcattttctttccatttgcaaaaaccatttctatatctaaagattttttgtccactatcaataaatccgcatcttttcctgactcaattgcgcccttattagctaatttcatgattgctgcaacgttcgatgttactactttaatagcgtcttcaattggcacattttgttcagtaattgcatatttaatttccctatataatgttgaaactgagcaaatttcatatccttctaactttccgtccttatcaaatttctccatgcttccatttccatctgaagtgaaagttatatgatctataggtaatttttcatctaagtatttttttaatccttcaccagctctaagttcaccttctcctaaattctctaggtcacagctagttgttaaatcaatgaaaccacctcttttaacatactctaaaccttccttaaatagcttgccgtttctattgatatgagtcggcaataactgagtctcaggaatttctgtcttatctagcaattcaaataaataatttaatttcctgtttccttcacctaaatgtatattaacaattccacatttatttgatagaagacctccaactctactttctgctactgcatttgcaaatacttcaaaggcttgctgagaacttctatgatctgaaatagctatttcccctattccgattatttcttcaatcaacattaaatcgctcttaattgagtctgttacagtcttaacaggcagctcatatgaaccagtaaaacagtatgcagacatgccatcttgttttagtgctttcacctttgctatcaatgatttcatgcttctgcatgttccatctgttcctatacatcctacaaccgtggttattcctgccttaaccaagctagataatggcatttcaggagttcttgtgttatatccaccttcgcctccagcacctataatgtgaacatgaccgtctataaaccctggaaaaagtaatttatttcttccatcaataacctcaacatctatcggagcaattttaatattaagattttcatatatcccttctattttgcccccgactatcacaacatcttttattccaaggtgtttaggtgcatacacgttacatcctttaattattgaaatcatattctcacctatcctttattttaaataaatactctaaatcatcacatctaataaaaaaatgccgattatgtgattatcttttcctaatagatatattaatatgacagtaatttgcttttaaattaagaagaataagtaattttaaatttgaaacttatttcttattccttaattatattttttatattattattagcatacattgaatctggataattatttattagtatacttgcatactgcttactcttatccttatttatagaactgtttaataatgccagattatagagtgcttcttctacatatacaccattaggatactgactataatattcctcatattgctttacagctgcagagttgtcagatagctttgaagagctgctggctctataaaataatatatgttcttttaaactattcccttcgcagtatgcatacgctttatctaaaaaaactttagcatctgaatatttattttcattaaaactctttaatccattttcataaaatcttgaaactccttgatcttttattaaatcaacagcttgcttatatactccttgatcatcactacttatagattcctgtttaatatcctttatttgttcatatataccatctaaatcattattatttattaatgctatcatcttatccttattaaatttaatattatcatgttcctcttttacttcttcctttaatgtctctggagtggattctttattatccttttcctcatatgtataagcttctttattaatatcgcttttatctttcgttgtttcttcaacagtattatttaaactcttatattttgatacagctgtatatccacccactacaatagcggccactataaccataattattattccaaataacccctttgaggagtttctttcctctataaatgttccactgtctttcaattctttctcgattttttttgctgtaattgcattcttatcgatatttagtactttctctgcatattctcttgctctgtagaaatcacctttcctttgatagcacatagcaattccagtattcaccttaatagcattaaaatcactttccgcacatctcataaatatatttaatgctttatcaacctttaactgctttaatgcttgttctccctgcctatataactctaatctctttctatctaaaatagaatcatttatgtaactttttgcaatatcatcattatttaaatcactattcatcttccatactgtaactgcttcttctaaattacccttttgatataataagagccctttaaagttcaatacatttgggttatccaaaccttctagtaatatatcttcacatatttctaaagctttatctatttgtcccatctcatagtaactcatagctttatcatgagcccttttaacctttttattcataaaattcccctttgtaatttttaatgcaatatgttttaccgattcataatatatattatatcgcactcaattataataattaaatataaaaattaaagctacctcaattaattttgagatagccttaattatataaacgatatattattcttgttctaacattatctttttagcatttaagattgatgtagcactcattgagaattcatctaatccatattcaactaatgttgggatagctgcttcatctccagccatttctccacacattccaacccatttaccatgtttatgagctccatcaatagtcatctttattaatcttaatactgctggatgcattggattataaagatatgaaactttttcgctcattctatcagctgctaatgtgtattgaattaagtcattagttcctattgagaagaaatcaacatgtttagctaattcatctgcataaactgctgctgctggaatttcaaccattataccccattggatcttttctgagtattcttttccttcagcttttaattctgccttacattcttcaacaacttctcttgcttgctcaaattcttctaatccagaaatcattgggaacataactgcaagatttccatatatagaagctctaagcaatgctcttaactgaactttaaatatatcttttctatctaaacaaagtcttattgctctatatcctaagaatggattcatttcttctggtaatggtaaatatggaagcgttttatctcctccgatatctaaagttcttataacaacttgcttaccttccattttttcaagaacaaatttatatgattcatattgttcgtcttctgttggagcactatctctatccatgtataaaaactctgttctgaataatccaacaccgtctccaccatttgctaaaacacctagtacatcttctggtttaccaatgtttccgcaaacttctattcttctacctgatttagtagttgttttaacatctattaatttctttaattcttcttgttctgcttggaattttgcttttttctctctatattctgctaaaacttcttctgatggatttataataacatctcctgttattccatcaactataactgcatctcctgttttaacagctgtagttatatcacctaatccaagtactgctggaatttctaaagttctagccattatagctgcatgtgaagttcttccacctatattagttataaatccaacaaccttagttctatctaatcctgctgtatcagatggagttaaatcatgagctacaactactgtattttcttcagtaattgcaaaagaatctccgcccttacctgcaaaatttgataatattctcttagatacatctttaatatcagcagctctttctctcatatattcattatccatagattcaaatatagcaacaaaagtatttgcaacactctcaatagcctttaatccatttatactattattttcaatttccatcatcattgctccagtaaattctgggtcatctaataatgtaatgtgtgcttcaaatacagctgccttctctgcacccatttctttttctgccttatctttaatagcttctaattgtactttagaatcatctaatgctttttgcatttttgctttttctgcatctatatctgcaattttactgtcatttataatgatttcctcatgctcttgtaaaaatacttttcctattgcatatcctttagaagcagcaataccttttttcataatatggaactcctccttgattgtaaatttcatttattaagtaagtatttcttacattaattcgtgtatttgcaagttttattttaagtataaaccttttctattataacataattcacaaaaaaattaacttaaatttaatcgttttttatgatttttactaaaaaaagtatctctccatttatctattaccatctattccctattatttttatattttataaatctatttataaatcatcaatcaaagttgtcacttttgcatacgcagtagatcttgcttcgaagaaatcagttttaacagaatttgcatttgatagagtatctacccatgaagctgggttcttatcttgctctttgaataatggagataaatttatttcttttaatcttttatttcctaaatattttatataattttcaattaattgcttatttattccttgtatcttatctcctataacataatgcccccataaaatttcttgttctacaccaatcttcatcatatttcttaattcattttttacttcttcagtaaatagctccggattttcattttgtagctcttttataatatttctaaaaagccacagatgagtattttcatccctatttatatacctaatttcttgtgctgatcctggcatcttaccatttctctccaggttatagaagaacataaatccagaataaaaatatataccttctaatatgtaattagccataagtgttcttaataaattgtattccgttggattctctataaattcattgtataagtctcctatgaatttatttcttttcaagagtatatcatcatctttccattgatataatatttcattccttttttcaggagaacatatgctatcaagcatgtagctatagctttgcgaatgtactgcttcttgaaaactttgaattgttaaacacagatttatctcacttgctgtaatataattatttatattacttaagtttgctgtttgtatagaatctagaaatattaagaatgacaatatcttatcatatgcaattctttcttcttctaataggttttgataatcctttaaatcttgtgaaagatttacttcctccggtatccagaaattattcattccttgcctataccagtctgaaacccagctatatttcatattattaaaatcatttaaatttgtagtattaccgtttataattctctttttactgatttctctatctcccaactcattaaaaagaggttttttatttatagtcatatctgcactcctattctctaagcattatatagctaacatgtgttagttatatagcaattaattctaaaaattttatatctaaatatatcataattattcatatattttatttttcataagttcaaataaccaagtagtatcaaagaactaaattaacttgagaactcaaatataaaatttgagttctcgtttatcaatctcactatgtataacctctgatgctaagtattgatacatagattataaagtacacttacgctgaacaagtttcacattctgtcacttctaatgattttgatctgacataatatatagatttaacgccacatttacatgcctctatatataagttcattatttgcctcattgtatagctactcgttatataaagattaaaggattgaccttgatctatatgcctttgacgtattccgttcattttaacacaccacatttgttctatattataagccgaattataataccaataattatcttctgaaagatttggtgcagtcttaggaattatacttccctttttttcttctagatagaatcttgccataataggatcaattccttctgttgttcctgcaattgttgccgtcgagccatttggtgctactgcaattaaatatccatttctagttccaaattcatgaactagctcctttagttcattccatttagcgctattgtagtttcttaatctgaaatactctccagtatcccaatcagatcccttaaacaattcatagaatcccttttcttttgatatgttcatactggcttttatagcatagtagtttatcttctcataaattttatccacaaaacttttatgttcttcttccgtccaatgtatcttattgttaacaagcatatgatgatatccactagttccaagacctattgccctatactttttgttcgtaatctcagcaaaaggaactgaataatagtttaagtcaattacattatccattgctctaatctgagtttcaacaacatattctacttcttcatcattacatacatctatatttccaagtactactgatgaaagattacatacaacaaaatctcctggtattattttctcaaccacagcatattcatctttatcactaagaatttgacttttttgtatcttcatcggactcatattctgcataatttcagtacataaatttgatgaatatatcattccgttatgcttattaggattcattttatttgtcatatctctataaaatgcgaatggtgctcctgtttcaactgcactctttatgattaatctcactaaatcttttactgacattactcttttctctattcgctcatcgcttacacattcataatacttttcttcccattgctctccataaaagtcttctaatgcatatcctttaatgttcttaatctcatgtggacacatcatatgccaattggcatctatatcattttcagcaagcctccaaaatagatctggatagcatatacctggaaatacgtcatgtgcctttttcctatcatccccattattagtccttatttgaagaaactcaggaatatccttatgccatgcatctaaccatattgccaccgagccatttctcacacctaactgatctacagctattgctgtatcattaaataatttaacccacggtattacccctccagatgctcccttaaatcctctgattggtgaacctaatgctctaatttttcccatatatatacccattccaccaccaaatttagatactttagcgaaattatcaagggatttatagattccctctaaactatcttccactgaatctataaagcatgaacttaattgataaaatggctttcgtgcattagacattgttggagttgccatagtggcttttaacgaactaagtacatcatagaatctcttggcccaatatactctattttcctctttctctggaattgcaagatgcatagctattcccataaacatttgctgaggaagctctatagggcttctattataatcttgaactaaatatctacttgctaaaagattgattccactataattaaatagaaaatccctttccggctttatatccttctccagttctaaaatatcttctcttgagtaattctttaaaatatattctccataaagacctctttcagttagagattcaataaattcgtaataatcctggtataaattcttatcatcctctaaatttctagaacttctaactctatcataaagttcatatgtatacgccctagctgctacatattgccaattaggctccatatctgtagttaattccagcgctacttgtatcaatgaatttcttatttctcttttattcatatcttttcttacaattggatttaaagcatctaataatttatcttctgtataaagtccctcattatctttaattgtattaatagcatctttgcataattcactcaaaagcgacattcaattatctctccctactacatattgtgttttttgtatgtaatttaattcttctatacaacatatcgtatattataattgttagcatcataattgtaaaaccttaaaatttatagatatatatgaaaaaagtagctaatctttagttttctatagattaactacctaattgataaaatttatttattaatattttttatcccttatttattggaagcataagataaattttaaacatatctccttctttttttattttaacttctccaccatgaagttcaactatactctttgtgattgctagacctagtccagaaccctctactttagaatttctagacttatcccctcttgcaaatctttcaaacatttcgtattcattaaaatccatttcgtaattagcaatatttttcacgccgacattaacataatcaccatctatttttacattaatataaaccctagtattgctcattgaatactttagtgcattaattattatattttctaaggctcttgacatcatctttccatcaagttccatatatacagcatcttcttcactagtcactttaaatgaaatatttttttcctcatataaagtactatattcacctataccttgatgtattaatgatagtatgtctattaactctctatttaacttaattttcccactattgatttttgacatttcaaataaatcttcaattaatacttttaattttagcgactttctctctaatattaataagtactcttctctttcttcctctgttatatcactattctttagtatgttaacataatttataattgatgttaaaggcgtctttaagtcatgcgatacattcgatattagttctgttttcagtttctcattgtggacaccatcttctaatatttccttatatcccgcttttattaagttaatattttttgcaagctcttttatcgcaggagacccatctaatttaatatcatcttgtaaattcccttcactaactcttctaagtgcatcatttaccactattatgtctagggtcttctttaatgcatacatcatagtgaaaaataagattataataacaaatacacttcctttaaacggatacgtttgaaaaaacttcacaaatatattattttcatatcctccagtagcaagaaaatataaatatgcaattaacaatatcaatgctaatgcaatagatattattaatttgctccttgtttctttataatgaaatccatttttaattacaaaaatcacattattaacaaaatcggattgtattctaggtgaattttgattctttttcaatatgaaaataatctttgtaataaacgccacatacataacagctaagaaaagtagtcctcttaaatcacttttaattctattaactgctaaactgtgttgcgacctattaatctgtatataatcacccaatgctgaaagtaaaaataatgttatcaatgctacaattattatatctactaaatagatgctactaaaatatatcttaatcttccttttcaatcttgtatccaatcccccacaccaccttgatatattcaggctcttttgtgtttatttcaattttttctcttattctcctaatatgtacggttaccgtattttcacttttgtaaaatatctcttcccatacgtgttcgtatatctctttaatagaaaatacttttcctaagtttgatgctagcaaatataatatcttgtattctgtagctgttaccttaacatcttctcctcgcaaagtaattttttttgcaacagtatctattaccaaatctttaactttaattatatccttaccctcttctacatttagcggtttctcatatcttcttaattgagatttaactcttgctaccaattctaagtggttgaatggtttagttatataatcatccgcccctacatttaatcctaatattttatctgaatcttcgccctttgcagataacattattataggtaagttttgactttctcttatctttaaacaagtacgtatcccatcaaatctaggcatcattatatctagtataattaaatgtattttttctttttcaagaatatctaaagcttccaatccatcctcagccttaaatacttttaaattttcgcctcttaaatatatttcaattgcatctcgtatttccttttcgtcatcaactactaatacattgaacatacaaattcctcctaaagttcacgtctcacataatattgttttacaatgaacttatcttctaaatattaattatacactgcttttttaaattcttctgaatttttaactgtatcaaaatcatgttcttcttttgctatttcctttattgatgcatccatttgtattgctttattcaaatacagcattgtattttttatgtctcctcttcttccataaatagatgctataccataataactccattcataatcttcaacatctaaagccttattataccattcaagtgcgtcatccatttttccatataattcatatgtaagtgccttattaaaccttgcatatccatagttattatcaatacttaatgccttatctatatcatctataccactattaaaatctccattataagacttcgcaattcctcttatattatatcccattgcattacttggaaattcacttataagcaaatctgctttgcttattgactcaatgtacttatgtgaaaaaaataaattatatgcttcgtcgtataattcattttccctttcagaataactagacttttcatttgttttatcatcaacagcctttttagaatcattcttcatatctatactttctagttctttattggctacattattatctgattgctgagttccctcaggcattactatttctttttcttctttatatttattatccttgctatttctattttctataaattcatgagctattatccccaatgctattaacactagtacaaataatagtattcttttatttttctcttttcctggtaacttaattctactcatatatttctccttttaatacggcttaatatataactccaatttattttaccgaatctaaatattctctttgaccaatttcatataagttatttccttgagcatcgataataacaactagaggcatatccttaacctccatttttcttatagcctcagctcctaaatcttcataagcgattatttcagacttaataatactttttcctattaatgcagctgctcctccaattgctccaaagtatactgcctcattccttttgattgaactaattacttcatcgtttcttgcacctttacctatcattccttttagtccaatgtccattaatttaggtgcataagcatccattctgtagctagttgttggaccagcagaccctataacagtccctggcttagctggtgatggtcctacatagtatataacctgatcttttatattaaaaggcagttccttcccttcatcaagcaattctattaatcttttatgtgcggcatctctagcagaatatattatcccacttaacaaaatactatctcctgcttttaattgtcttatcttttcttcattaagaggtgtctctaatttaatttccataccttttctccaatcatacatataatttcaatttttatttctaatacattcttaccaattagacttttaataaaatatataactctaaaaaatttaattcatcaaagcttcatcttaaatagtcaaataatgaaagttaggcaattcataaagaattagctatgttatttagaacttatatatatcttatttaaatcatagtttttatagtattacctctttatgtctagtagcatgacaatttatatttaccgcaacaggtaaccccgcaatatgagttgaataagtctctatatttaaccctaatgcagttgttttacctccgaatccttgtggtccaattcctaatttatttacttcttgtaatagttccaattctaattccttgtaaaattcatcttcattccttatattgataggtcttaataatgcttttttagctaagtatgctgccttatcaaaagtccctccaattccaacacctattaccataggagggcatgggttaggtcctgccgctttaactgtatctattatgaacttcttcactccatccagtccatctgatggctttaacatacctattctgctcatattttcagaaccaaatccctttggtgctaatatgatcttaaccttatcaccatccactatgtcataatatattatagctggagtgttgtcctttgtattaactcttcttatcggatctttcactaccgattttcttagaaatccttcctcatatcccctacgtacgccttcattaatagcatcttcaatccttccgccaactaaatggacatcttgtcctatttcaataaatacacatgccattcccgtatcttggcacataggcattttttcatttcttgcaatttctgaatttattaatatcttatctaaaacatcggatgctaatttccatggttcttctttcttagcatttaataatgcatcattaatatctgatcccaagaaataattagcttcaattgataaatttttaatagcttctgttataagttcaacatttatttctctcattcttacagctcctttattatcgcttataaactatacatttaaacttattactacatataagtttaaaagtatttcttactatttacaaccccaaataaattttatttaatccaataattctcaaagctccatacaagcaattgcggtatatactgtacatcataatcataaacggagcattctctatgatgatttttagtatttttctgcttaatattactaaatactttctctatttttaaatttatcgctcataattatagttcattactactataattatatatatatgttgcaataactggcttacatttaaaatacttgtaagccaagtattgaatttcaaaaatgcaggaattcaattgcaacatatataattattttatatatttgagaggttaatttatgaaccctaaaaatttagataaattcctaagtatactaatttactttttaattgttcttttaacctgtttgctattgtataatctttttttattagtagacaaattataccacgcttatgactatccaaaaaacagcataaaagttggtcctattcttatgaaattaaataactagctatctttactttcaaaatatttattgataccagctgttattccttttgctattttgtcctgatgttcatcgctttttagtttttgctcttcctcataattagataaaaagccacattctacgagaacgcatgcaccctcatatccatctctaagtattctatattgttcctttgcagccttaggaactctcttattgttatcatttattgtttctttgagtgatacttgaatattttctgctaaagacttgctgatctcattagatgaataccaaacttgagacccaaagcaactggactgtggaaacatattctgatgtatagatataaatgcatcacatttaacatccttcttcatttgacatctggcattaagatctttaactttcttcgcatctaattgtgaatccccttctcttgtcatatacacagcatatccagagtcctccaactccttttttaactttaaagatatagatagatttatatccttctctatagttccactctttgattttgctccaccgtcaattcctccatgtccaggatctattaatattatccttttatctttattttcttcggaatttgtccttaccggaattccagacattaagcaaaatatgcagaacaatgctatccattttttcattctcataaaactgttcctccaaatcatttagacttacatactgtattgtttgctatacaatcttaattattcaaattcatttatattaataaacttttattttttgttaaacatattttatagaacacccaatagatgcatcaccacaatttttaatataatatctaaaatatttaatcaattgaaatccatctgtaattaccatatatagaaatgttaataattttataaaaaatgaattataccatttagaacttatatatacatgaatatatattgtatataatagagctatatttagacttgtaatagctaaagaattcatttaaggcaaaatatataggcttagcttgaacatatatatatataatagaagagtttataactatattaggaagtggcaccagaaccgtattactagaaatgtaataactattatttatatttgttctttaagattacatatttttatataaaataaaaatcccacaaacaccgcgtttgtgggatttttgatctccaaatattatctctttgagaattgtggagctcttcttgctgctttaagaccgtatttctttctttctttcattcttgggtctcttgttaagaatccagccttctttaattctggctttaaagcttcatcagatttaactaatgctctagctataccatgtctaatagctcctgcttgacctgtaaatccaccaccgtgaacatttactaaaacgtcaaatctatccttagttccagttaaaactaatggttggtttacgataactcttaatgtttctaaaccaaaaaagttttctatttctcttttatttacaagaaccttaccacttcctggtacaagtcttactcttgcaactgatttctttcttcttccagttcccatgtattgaacttttgccatttctttttcctcctcccgagatcgtattagtatcttaattctagtacttctggtttttgagctgcatgattatgttctgcacctctatatacatttaatttctttaacatttgtcttcctaaaacaccgtttggaagcattcttcttactgcttcttcaaaagcaaattcaggctttttatctaatactactctataaggagtttcttttaatccgcctgggtaaagactatgctttctcattaatttttgatctaatttcttaccagttaaaactaccttttctgcattaattacaataacaaaatctccgcagtcaacattaggtgtaaatgttggtttatttttacctcttaaaattgaagcaacttggctagcaactctacctagtggcttaccagcagcatcaactacataccattttctttcaatttcacttgctttagcaatgtatgatttcatctgtttccctccctgaacttacattaattctttacttattattttaagtaagattttttatgtcaagacccggggctagtggatcttatatacataaatgttttaacaaacaaacctattataatacacgcacacgggcgtgtcaacacatttttatcatttaatagaaaactttttctaatattaatccgtttggcggtacgcacattcctgctttttttctatttccttcttctattatatcttttatattttccacttctagttttccatttccaatctttattaatgtacctactattattctcaccatattatacaaaaatccatcagccgtaataaatatttttatttcatttccattttgatctatatatagatcatgaatagttcttgttgtagtttttattgagcttcctggagacataaacgccctaaagtcatgcctccctataaaatattcacatgctcttctcatctcatttacatccaatctatacttataatgatacagatattggtgacctaaagataacctttcatatctatttataattgtataagagtatgtctttccctttgatgaatatcttgcatgaaaatcttcacttacttcttctgatttaattatagatacatcttctggcagtcttgtattaatagcttctctaaacttatctccaggtattgaagaattagtcaaaaagtttgcaaccatttctcttgcgtgaacacccgcatcagtcctggaacttccattaatcataatttcctctccagtagccttaaatattgctgtctctattactttttgaatagttctgcctttgggttgcctttgccatccgcaaaagttacttccatcaaactcaataattaattttatatttctcatttaagttatcttactcctatagcataataaatcttacagctatgcaccataaaactaaaatacaaaatacaataaaagcaaccaagtccctatacgaaaattcaagtattttcattctagttcgcccagcaccacctctatagcctcttgcttccattgccattgctaattcatctgctcttctaaatgaactgataaataaaggcactaatagtggtactaagctcttagccttttttattattccgcctgactcaaaatcagcccctctagccttctgagctttaattattttatccgtttcatctattaaagtaggtataaatcgtaaggctattgtcatcatcatagcaagttcatgagccatttcttttccaatcggccgtaataatttttcgattccatcagttaactcaattggagatgttgttaatgttaacagtgatgttcctactattaatagaattagtcttattgccataaatgctgcaatacttaacccctccggatatgcctttaaaaatccaatactaaaaacttctgtcccttcagcgcccctaaccataaatatatttagagcagctgttaagactatcaataggaaaattggcttcaatccattaaaaataaatctaaatggcacctttgcgatcaatattatagctagtaaaaaaacaacaacaaaagtataacctataaatttatttatgataaataaacatgcaataaaaagtattgatataaggatctttgttctaggatctaacttatgaacaaatgactctccaggtaaatattgtcctattgtaatattcttcaacataattttgtctattcccctttcactttatttatcctcaaagtagacaaaagttgcttttttgcttcctctatcgtaaatatattatctggaatgtcaaatcctttttttcttagttctcttattagatatgttacctgagggacaccaagtcctatcttctctagcacatcaacttctttaaatacttctgctggagttccttgtaatgctactttcccaccattcatcacaataattctttctgcaatctttgcaacatcctccatactatgactaactataattatagtcatattataatcctcatgtagctttcttatctgatttaatatatcatctctaccctttggatctaatcctgccgtaggctcatccaatattagtgttgtaggttgcattgctataacccctgcaattgctactcttctcttctggccgccgcttaagtcaaatggagacctatctttataagtctcatagtccagaccaaccatttccatagccctaattactctattattaatttcgctatcagaaagtcctaaatttctaggcccaaattcaatatccttagctatagtttcctcaaagatttgatattctggatactgaaataccaagccaaccttttttcttatatccgtaagctttgcttttttatcagtaatatttattccatcaacaattatttctccactagttgcttctagtaaaccattaaaatgttgtattaaagtagatttaccagagccagtatgcccaattagtgctacaaattctccatcttttatttctaaagacacattgtctaatgcagtcttttcaaatggactcttaggcatatatatgtgtgttaaattttctactttaattgacataattcattcaccatctcatccacatttaatattttttcatttatatctattcctgccttttttagctcataagctaattcagtaacctgtggaacatctaaccctatttttttcattcgctctacctgaggaaaaatttctctaggagtcccctccatttttacacttccaccatccattactacaattctatcagcttgagctgcctcatccatgtaatgtgttattaatacaatagtaataccatgaattttatttaattcatttatggtttttagaacttcccttcttcctgatggatccaacattgctgtcggctcatcgaaaattatacattcgggttgtattgcaagtatccctgctatagcaattctttgcttttgcccaccagataaaagatgtggtgcatgccttttatatttgctcattccaaccttctccaggctttcatcgactctttttcttatctctaaaggttctattcctaaattctctggtccaaaagctacatcttcttctactatggtagcaactaattggttatcaggattttgaaacaccattcctgctctagatctaatctcccaaacattctccattttactagtatccaagccatctacaatcactgttccctctgatggtacgaccaatgcattcatatgcttagctatcgttgatttacctgatccattatgacctaaaactactaaaaactcccccttttttacctccaaatctacatcttttattgcatatttttcttgcttaactccttctgtatcctttacatatttaaaagatacttttgcacactttatcatcgcatcactcatagtgtacctccccatgatgttttatagttttaatatattatacaaatgtttttcaaaaacaacattgttatctttgatattaaattattattttcattatatctcaaaatccaacatattcaacaaaaaatatatatcttgagtaagaaaacatctctataataaattaagttccaattttattttctatgtcaaaatggggattaagtttaaacttaatcccccattagtattatactaattcaagtattactatctcagctccgtcccctcttctaggaccttttttaattattcttgtatatccgccatttctttcagtatactttggagctacattatcaaataaattcttaacaactaattcttcttgaacataagataatacttgtcttctagcatgaagatctcctctttttccaagagtaatcattttttctgctattgatctagtttctttagctcttgtttcagttgtctcgattttaccatgttttaatagactagtaacaagatttcttagcatagctcttctttggtctgtaggaagacctaatttacgatgacctgccatggatttacctccttactcctcggttagttttagggctaaacctaattctttaagctttctttcaacttcttctaaagatttctttcctagattccttactttcatcatatcatccatagattttgtagcaagttcttggactgtattaattccggctctttttaaacagttatatgatctaactgataaatcaagttcttctacagtcatttctaggactttttctttcttatcgtcttctttttctatcattatttcaacgtcattagtattatctgttaatgacatgaataatttaaagtgttcaataagtatttttgctgataaactaatagcttcatctatttttatagtaccattagtccaaatttctaaagttaatttatcataatcagtaatttgaccaactcttgtattatcaacagtaaaattaactctttttactggtgtataaatagaatcaactgctatagcagaaattggtaattcatcactcttatttttattctgagtaacatatcctcttcctttattaactgtcaattccatataaagtcttccatcgttatctaaagttgcaatatgtaaattcttattaacaacttcaacatcaccatcagtctttatatctgctccagtaacttctcctggtcctttagcatcaatataaataacttttggaccttcaccattcattcttagagctaatgatttgatattaagaattaattcagtaacatcttctttaactccttgaacagtagaaaactcatgaagcacaccgtcaattttgacagaggttgttgcaactcctggaagggatgataatagtattcttcttagggcatttcctaatgtaataccgtatcctctttcaagtggttcaacaacgtacttaccataagtaccatcttcattagcttctatacattctattattggcttttcgatttctaacattgacaaaccctccttattttaaaaatggcaaccttattatgagggcaactgattctatatttgcatatattgtgataaatttctctaacaaatataaatatattatttactgtataactcaacaataagtgtttcgttaacaggcacatctatatcttctcttgatggctctgcaactacttttccttcatagttatcaacattagcttctaaccattttggtaaagtttttggattttcaacaaaagttttaaacttttcacttgatctgctcttttcgcatacagtaattacatcattaactgaaacatgatatgaacaaatgtcaacctttttaccatttactaagaaatgtccgtgagttactaattgtcttgcctcatttcttgatgaaccataacctaatctataaactatgttatcaagtctcatttctagtaatttaagtaagttttcacctgttatacctttaatatgctcagctttttcataatatgttctaaattggccttctaatatgccataaattcttcttgctttttgcttttctcttaattgaacaccatagtttgatactttctttttgttagctccatgttgtcctggtgcatagcttcttctaacgaaagcacacttatctgtaaaacatctatcacctttaaggaaaagtttcataccttctcttctacataatctacatgtagcgccagtatatcttgccattaaattacacctcctattactacatttatattagactcttcttctctttggtggtctacaaccattatgtggtattggagtaacatctttaatcaaagttacttctagtcctgctgcttgtaaggatcttatagctgcttctcttcctgaaccaggtcctttaacataaacctctatactttttaagccgtgttccattgctactttagctgcagtttctgctgccatttgagctgcaaatggtgtgctctttcttgatcctctgaaacctagtgctcctgcacttgaccatgataaagcatttcctactgcatctgttaaagtaactattgaattattaaaagttgacttaatgtgtgcagcaccatgctcaacattttttctttcttttcttcttctagttttctttactgttttagctgccattatcttccctccttactatttcttcttatttgctattgtcttcttaggaccttttctagttcttgcattagtcttagttttttgtcctcttactggaagacctcttctatgtctaattcctctatatgatcctatttctactaatctcttgatatttaaagcgacatctcttcttaagtcaccttcaaccattaaattcttgttgatataagttctgatttcattaacttcttcttctgataaatccttaactcttgtatctggattaattcctgttacagctaagattttttgtgaagttgataatcctattccatatatatatgttaaacctatttcaactcttttttctcttggtagatcaatacctgatattcttgccattaaaatttacacctcctgataattgaaatgtataaaagttgattttataatttatgatttataatttataataaaattttaggtcaatagacgattctattgccagccgccctaaaatttatttttgattaattaaacgactatataatcatatttgacttttgctgaaatgtcaatattatttacatttattttaatgtaaataatattgtaaacttgatcattagccttgcttttgcttgtgcttaggattttcacagattaccattacttttccttttcttctgattactttgcacttttcacaaataggcttaactgatggtcttactttcatagctaaccctcctcatattacttttgtagtagatcaatgtaagttatatctactttattttgctctccatgtaattctacctctggttaaatcataaggagaaagttctactgtaactttatctcctggtaaaattcttatgaagttcattcttaatttacctgatatatgtgctagaatcttatggccactttcaagttcaacttgaaacatagcgtttggtaaagattctaataccgtaccttgcatttctataacatcatcttttgacataaggtaatcaaccctccttaacaatgcctctaagctttaggaatctcttaatctttaaattagtactcttatcgcatgagtttattaatgataataattcatcatctacatcttctaaaatacttaagtgtttaatttttttcttcttaggcatctcaattaattttgtatctccattagctagtaatacataatcatcatctatctgcctaacaacaacatataagtgatctttatctcttcctgcttttgaaagtactacttttccaatcaagtcattgttttgcaaatttttcacctctatgattaccttagtataaattaacactaccacaacggtattatgcaaatttataactaagcaacactctttattctacttaatcagtgttaatatttcaggtccatctgataaaattgcaactgtattttcataatgtgccgataaagaagtatctgctgttacaactgtccatccatcttttaatgtcttaaccttataagtaccagcgttaaccataggttctattgctaacaccataccctccagtaatttcggacctctaccagactttccgaaattaggtacattaggatcctcatgaacttttcgcccaatcccatgacctacaaaatctcttacaactgagaaacctgctgcttctacgtagctttgtatctcatgtgatatatcagttaatttatttccttgttttgcaaactttataccttggaaaaaactttctcttgttatatcaattaatctttgagcttctactgaaacttcccctacagagaaagttcttgcagcatctccatggaatccatcaaaaaacgccccacagtcaatactaactatatcgccttctttaagaacatattctcctgggaatccatgtattacttgctcatttactgaaatacatagtgacgaaggaaaaccatataagcctttaaatgaaggttttgctccatgcttagttataaattcttctgctattctatccaaacttgcagttattactccgggttttacctctttttcaagcaatagcaatgtttctcctactattctacctgcttttctcattatggctatttcatcatgattctttacagtaatcattatttgttgttccctaacaattcacatattcctctaaaaacttcattaatagcttttgtgccatcaacttctgaaagcaagcctttttcaccgtaaaattcaattagcggttgtgtttccttttgatatacatcaagtctttcctttacagtctcaactgtatcatcttttctctgtataacttcacttccacacaaatcacattttccttcatttgttggaggattaaatttaacatgataacttgctccgcatgatggacatactcttctgccagtcattctttctagaataaattcattaggtacctttataagcaatgcggtatctaattgttcattcttatctacaagaaagttgttaagagcatcagcttgagccacagttctaggaaaaccatctaataaatatccgaccttacaatcgtcctgttgcagtctatccttaaccatattaattgttacttcatcaggaactaattgtccgttatcaatataaccctttgcttctattcctaagggagtgttttcagaaatattctttctgaaaatatcacctgtagaaatatgtggtattgaatatttattgctaattgatttagcctgtgttccctttccagctccaggaggacctagtaatactatcttcactggcttcatctccatttattctaatctatttaagaaatcctttatagtgcctaactaccatttgtgattctacttttctagtaaaatctaacgcaacatttataacaattaataatccagttcccgaaaaagctatattttgaaattgtgtataattttgtatcataactggagttacagccaataccgctgctaatatacctccaataaaagatagtctgtttaaaactctttcaaaatatgttgtggtttcttcacctggtcttactccaggcacaaatcctgctgatttatgcaaattctcagacatttcatctggtttaaatgtaatctgagtataaaaccaattaaagaatattgtcagtactgcatatagtaccatatacatccaactcttattattaaagatagatgtaggattatttaatacccactttgcccactctttttgactttcacctactccaccaaataatgtggcaatagtttttggaaaatccattacggacatagaaaatataatagcaagaaccgctgatccaattatacttaatggtatatgtgttgattgtgatttaaccatattactattgcctgatgcaaatttaccagcatactgcacaggtatccttctttctgataaagaaaaatatagtatagtagcaagtagaaatacggtaaatactccaaatagtacaatttccacaatacttgcacttcctgcttgctgaagtgtcatcattgaagcaattgttgctggaactctcgaaattatattaacgaatattagtattgaagtaccatttccaatgcctttaactgtaagttgatcacctaaccacatacaaaatgttgttccaaccactagtgcaaaaacaacaatagtcttttggattgcagttaatccaactgtagctccactacttgaaattgttgcaaaaattccataagctaagataaaagctattccaagagatacataacgtgttgcattttgtatcttttttctgccagtatctccttcttttgatagttgctccaattgtgggatagcaacagttaataattgaattattattgatgcattaatgtatggcataactcctaatgctaatatactagatctgctaaaagctcctccagaaagcatatcataaaatcctaatagtccaccagactgagatagattttttaaaaaatcagagttaattccaggaagaggaatatgacttcccatcctgaaaactgcaactaataatactgtccataaaatcttttttctaagttcaggaactttgaatgcattgcttaaagtttgaagcactttacatcacctcaacttttcccccagctgcttcaatcttttctatagcagacttagagaacttacatcctttaaccgttaagcttttttctaatgttccgtttccaagaatctttactccatccaaaaccttacttacaactcttctttcaagtaataattctggagtaacttcagtaccattttcaaagatatttaatctgtcaagatttatgctaacaatcttctttgcaaaaatgtttgtaaaacctctcttaggaagtcttctatataaaggcatttgaccgccttcaaaaccaggtcttacgccaccacctgatcttgcattttgacccttttcacctttaccagcatttcttcctaatccagaaccagtacctctaccaattcttttaggtgctttcttgctacctgctgctggttttaattcgtgaagtttcatattcagtgcacctccttgtttttatacttcttctacttttaatagatattcaatcttttttatcataccttgaacttgaggtgttgcctcaggttctactgtttttcttatctttgttagtccaagagcatttgcagtagcgatatggtctttttttctacctattaagctcttaactaatgtaattcttaatttagccattgcaatatctccttaacctaatatttcttcaacagatttgcctcttaatttagctatatcttctactgttcttaagctagctaatccgtttattgtagcatttaccatgttattaggattatttgaacctaatgatttagctctaacatcctttaatcctgctaattcaagtactgctcttgctggacctccagcaataactcctgtaccttctttagctggcataattagaacatttgcagttccgaacttaccattaacttggtgaggaattgttgttcctaccattgcaacgcttactaagttcttcttagcatcttctattcctttttttattgcttctgggatttcgattgacttacccattccaacgccaacgtgtccgttctcgtctccgacaacaactagagcgctgaatctgaagtttctaccacccttaacaaccttagtaactctgtttatgaaaacaaccttttctttaaggtctagtgtactaggatcgattctcatttatttccctccttgtttaattagaatttcaagccagcttctctagctgcttgtgctaattcttgaattcttccgtgatatatgtatccgcctctatcaaataccactacgtcaattcctttttctatagcttttttagctactaattcacctacaagtttagcaccttctttgtttccgccttttgcagcaaaatctttttctaaacttgaagcagctactaatgtaacaccatttatatcatcaataacttgtgcatatatattcttttcactcttaaatactgaaagtcttggtctttccgcagttccaaaaacttttttacgaactctaaggtgacgtttttctctgctcgcctttttgtctacctttttgaacataaaactcactcctttctattatttcttaccagtcttaccttctttacgtctgatcacttcattttcatacttaatacctttacccttatatggttctggtactctccattttcttatatccgctgcagcaaatccaactttttccttgtcgattccactaactattactctagttgcagctggagtttcaaatgtgatcccgtcaataggttcaatttcaactggatgtgaatatccaaggttcattacaagctttttaccttgtaattgagctctataaccaacaccaactaaatctaaagttttttggtacccttgttttactccaattaccatattattaattaatgctcttgttaaaccgtgaagagctctgtgatctttttgttcactatgtctagtaacaattacttcattgttttcaacagctatgctaatatctttatgcatagttttaactaattcaccttttggtcccttaactgtaactaaattgtctggtgttacagtaacagttacatcagcaggaatagctattggtaatctacctactcttgacataattgcacctcctgtattattttaaaattgcattttacaattttatctagtttaatttatctgagatattaccaaacgtagcagattacttctccacctaatccgttctttctagcttctctatctaccattattccatttgaagttgaaacaacagcgatacctaatccattaagaacttttggtacctcgtctttcttgcaataaactcttaatcctggtttagaaattctcttaataccagttataactctttctttattagctccatacttaagagataatcttaacattggaacaactccatcgttatattcatttatttcttttatataaccctcttgtaataatatatttgcaatttccttctttacgtttgaagaaggtacttctaccacttcatgtcttacagcattagcatttcttacacgagttaataaatctgctataggatctgtcataaccatttaatgtgcctcctttcgttacatcgtatatcttaccaacttgcttttctacaacctggaatttcgcccttataagcaagttctctaaaacaaatacggcatactccatatttttttaatacagcatgtggtcttccacatattctacatcttgtataagctcttgtcttgtatttaggagttttgctccacttttcaataatagccttacgtgccaatgtgtttccctccttattattgagcgaatggcattccaaggaatcttaataattccctagcttcttcgtcagtgttagctgtagtaacgaagattatatccattcctctaactttatctatcttatcatattctatttctgggaatattaattgttctttaattcctaatgaataatttcctctaccatcaaaagctttgctagaaacccctctgaaatctctaactcttggtagtgcgatgctcattagtttatcagcaaattcaaacatgttagcttttcttagagtaactttgcatcctaatggcatattttctctaattttaaagttagctacagactttttagctcttgttaatacaggcttttgacctgctattaaagtcaaatcattaactgctgattctagcactttttgattttccttagcttctccaactcccatgttgattactatcttctctagctttggtacttccattatgtttttatatccgaacttttcaatcatagctggaactacttctttttgatatttttcttgaagtcttgtcatattagttacctcctttcaaaatctagaatgtttctccgcattttttacatactctaaccttagtaccatcatctaaaactttgttactaattctagtcgcattcttacatttgttacaatataacataacttttgagctgttgattgctgcttctttttcaattatagcgctttcaacttgacccttattagctttttgatgttttttaactatattaactccttgaacaagaacttttcctgtctttggatacgcttttaacacttcaccagttttgcctttatcttttccagatataacaataactgtatcattctttcttacatgtatcttcaagttggccacctcctcttatagaacttctggtgctaatgataaaattttagtgaattctttatctcttagctccctagcaacaggtccaaagatacgagttcctcttggttgtttatcatctttgattataactgctgcgttttcgtcaaatttaatatatgaaccatcagctcttcttacaccttttactgatctaactacaactgcctttacaacatcaccttttttaacaactccacctggtgttgcacttttaacgctagcaactataacatcgccgatattaccaaactttcttttagatccacctaatactctgatacacataatttcttttgcacctgaattatctgcaacctttaataaggtttgttgttgtatcattaaattaccctcctttcagttttaaagcttatttagccttttcaactatttcaacaagtctccatctcttatctttagataaaggtctagtttccattattgatactctatcattaattttagcttcattattctcatcatgtactttaaactttgtagttctattaactgtcttaccgtataatgggtgtctaaccttagtttcaacagcaactacaatagttttttccattttatcagaaacaaccctaccaattcttttctttcttaatgatctttccattagggcttacctccttccaacttttattgttccaatgcttttaattcttcttctcttaagatggtttttatttgggctatagatttcttaacttctcttattctcattggattttctaattgtcctgtagctaattgaaatcttaaattaaatagctccgctttaagatcgcccaatttaactgttaaatcttgaggattgcttgatttcaattcttttaattctctagccttcattattcttcaccacccatttcctcaaaatctctttttgaaacaaattttgtttttacaggaagtttatgtgaagcaagtctcattgcttctcttgcagtttcttctggtactcctgataattcaaatagtactctacctggtttaactactgcaacccagtattctggtgatcctttacctgaacccattcttgtttcagctggcttttctgtaactggtttatctgggaaaatctttatccaaagctttccacctcttttaatgtatctattgatagcaattctggcagattcaatttggttacttgttatccatccacaagttagcgcttggattccgtaatcaccataagctaagaaattacctcttgtagctttacctttcattctaccacgttgcaccttacgatgttttacccttttaggcattaacatgatctattcctcctttcctatgcgttagcctcttccttttctactttcttagttggaagaacttctccattataaacccaaaccttaactccgatttttccatatgttgtatctgcttcagcaaatccataatcaatatcagctcttaatgtttgtagtggaattgttccttcatgataatgttcagttcttgctatttctgctccacctaatctaccagaacaagcagtttttacaccctttattccgtgtttcatagctctttgcattgtttgcttcatagctcttctgaatgaaattctcttttctaattgtgcagcaatattttcagccattaattgtgcatcagcttctgcacttttaacttcaactatgtttattaaaacattcttattttcaacgaattgagttaatttattttttaaagcctcaattccagatccacctttacctattataacaccaggctttgctgtatatatgtttaattttactcttttagcagctctttcaatttcaattttagaaatacctgcagaaaaaagttcctttttcacaaattttctaatcttgttatcttctataagattatcagcaaaattcttcttgttagcataccattttgcgtcccatcccttgataacacctactctaaggccatgaggatttactttttgacccacttgcttttccctccttttatcttattaagctctttctttaacaactactgttatattgcttgttttctttaatattttaaatgctctaccttgagcatgaggttggaatctctttaatgttgatccttgaccaacgaaacattccgaaacatataagttatcagcattcaattccaaattgttttctgcattagcaacagctgattttaaaactttatttataactacagctgcttctcttggagtatattgtaaaatagcaaaagcttcgttaacttgttttcctcttattaaatcaagaattactcctacctttgttggagacattctaatatattttgctatagctctagcttccatttatgatcctcctttccaggctatctttttgatgttttatcgtcatgacctttataagttctagttaatacaaactcacctaacttatggccaaccatatcttctgatacatacactggtacatgctttcttccatcatgaacagcaattgtatgacctatgaattgtggaaaaattgttgaacttcttgaccaagtcttaacaacctttttttctccattaccattcatttcttctattttcttaaaaagtccttcatgaacaaaaggtgctttctttgttgatctactcactaatatgcctcccttcataaacactaaggtctaagctgtgaagagaacttactattctcctcaaactacttagctcttctatctttgataataaatttatctgaatatttcttagtctttctagttttgtatccaagtgctggtttaccccatggagtaactggacttggtctaccaactggagatttaccttcaccaccaccatgagggtgatcattagggttcattacagatcctctaactgttggtctccatcccatatgtctctttctaccagctttaccgatattaacaatatcgtttgttgcattagaaagtgttcctattgtagctctacattcgattcttacatatctcatttcacctgatggtaatctaagagttgcataatctccttctttagccattaattgagctgatccacctgctgctctaactaattgaccacctttacctctttgtaattctatgttgtgaataactgtacctactggtatgttctttaatggaagtgcattaccaggtttgatatcagcattaactccagactctattacatctccaacttttaatcctgctggtgcaagaatatatctcttttctccatcgctatatatagcaagagcaatatatgctgatctgtttggatcatattctatagttgcaacctttgctgggatttcatctttatttcttttaaagtctattattctatattttctcttaacaccgccgccacgatgtctaacagtaattttaccttgagcatttctacccgctttactctttaatgcaacaagaagtgacttttctggttcttgtgaagttatttcttcaaaagttggcatagtcatttgtcttcttgctggtgtaatagggttaaactttttaactgccatttaaaattccctccttcttcaagcttctctggtgttgatcaccaataatggctttattctactattattgcattccctcgaagaattcaattccattactttcttcagttaatgtaactatagctttcttgtaatctgatctcttacctacatgtacgcccattctcttagttttacctaagccgtttatagtgttaacagattcaactttaacattgaaaacttcttccacagctctctttatttgagatttattagcatcaacatgaactatgaaagtgtaccttttttcggccatagacgccatacttttttcagttatgattggctttcttattatatcatggcttgttaatttcattatgcgtacacctcctcaatttttgatacagcatctttagttatgattaatttttcatatttcaataaatcatatacattgatgttgtttgcaggaataacacttattccttgaatgtttcttgctgacttataaacaacttcatttgattcagctgttataattaatgctttattagcttctaaagcctttagcatttctatcatgctcttagtttttggtgcttcaaaatttaatgaatcaagaactatcatttgattatcttgaaccttgctagttaaagcagatttcatagcaacctttctcatactctttggaactgaaactctgtagtctcttggctttggtgcgaatacaattccacctttgatccattgtggtgatctgatagaaccttgtcttgctcttccagtacccttttgtctccaaggcttgattccgcctcctctaacttcagatctagttttagttgattgagttccttgtcttttgttagctaataatgcaactactacttggtgcaatgcatattcattaatttctgctgcaaatacattttcatttaactccatatctgcaactttatttccttctttattaaatactcctactgtaggcattttatttcctcctttcttcaaagaaattaagctctaactgtatctttaattactactgtacctttattaggtcctgggattccacccttaattagtattaaattcttttcagctattactttaacaacttctaaattaagtactgttgtatttacagatcccatatgtcctggcattctcttgtttttgaatgttctagatggatctgatgaagctcccattgaacctggtgctctatggaacttagaaccatgagtcataggtcctctttgttgattccatcttttaattgatccttggaaaccctttcccttagatactgcagatacatcaactttatctcctgctccaaatacatcagcttttatttcatttccaacttcgtattgacttatatcgtcaagtctaaattctttaagagttcttcttaaagtagctccagccttagcaaagtgaccttttcttggcttattagctaacttttctctaatttcatcgaaaccaacttgtattgcttcataaccatcattttctaatgttttcttttgaacaacaacacatgggccagcttctactacagttacaggaatcacttttcctttttcatcaaaaatttgtgtcattccaacttttcttccaattatagcttttttcatgtatttacacctcccaaactaattagcggactgttaacaatcataactagccgttttatattattcccagtactaaagcttgatttctatatcaacacccgctggaagatttaatctcattaatgcatcaacagttttaggtgatggattaacaatatcgattaatctcttatgagttcttatctcaaattgttctcttgaatctttgtacttgtgaaccgctcttaatattgtaacaacatctttttcagttggtagtggcactggtcctacaaccttagctcctgatgtttttgcagtttcaacaattttttcagctgattgatctaaaattgtatgatcaaaagcctttaatctaattcttattttttgctttgacatttcatttccctccttttatgtacgttttacttctaacgcacaacagcggctattctgtaaactgttccaggtgtttcgtgatatccaaacttaatacagaatccctgtcgtcggattctagatccaaacttactcatcaagaattacccggaagtccggcaacctcttgaatcctcgctgtatgctatgcaacttcttaattatactattgttatattgtcttttcaagcttttttttatattttcctaattttttttaattccttatattggatgattttttagatatctttactaaaattttatatcagtttgtcataatttattttcgataataaataaatatttgtgatgacaatctaattttattatgaaatactaatcaaattatataatttataaaataaaagcaaggtgtaatttccttgcttttactgtcgaacataaatgtatcttattctactattttagtaacaactccagaacctacagttcttccgccttctctgatagcgaatcttaatccttcatccattgcgattggagtgattaattcaacattcatatcaatgtgatctccaggcattaccatttccattccatctggtaacttgattgatcctgtaacgtctgttgttctgaaatagaattgtggtctgtatccatcaaagaatggagtatgtcttccaccttcttcttttttaagtacgtatacttgacctacaaatttagtgtgagggtgtactgaatttggttttgataaaacttgacctctttcaatatcagttctttgaactcctcttaataatgctccgatgttatctccagcttgtgcttcatccaataactttctgaacatttcgattccagttactacaactttcttcttttcttctgttaatccaacgatttctacttcgtctcctacatgaagtactccagcttcaactcttcctgttgcaactgttcctcttcctgtaattgtgaatacatcttcgattggcattaagaatggcttatctgttgctctttctggagttgggatatagctgtctactgcttccattaaatccatgattggcttaattgcttcttcatctgttggattttctaatgcttttaatgctgatcctgttattactggaatatcgtctcctgggaagtcatattcgcttaataattctcttacttccatttctactaattctaataattctggatcgtctaccatgtctgctttatttaagaatactacgatatattggataccaactcttgatcctagtagtatatgttctcttgtttgtggcattggaccatctgctgctgatacaactaagatagctccatccatttgtgctgctcctgtaatcatgttcttaacatagtcagcatgccctggacagtcaacgtgagcatagtgtctgttttctgtttgatactcaacgtgtgctgtattgattgtgattcctctttctttttcttctggagccttatcaatatccgcatagttaaatgcttctgcaaatcctttatttgctaatactgttgtgattgctgctgttaatgttgtcttaccgtggtctacgtgacctattgttccaatattaacgtgtggcttacttctttcatactttgcttttgccattataattttcctcccttgatagacataatttaaagaatcttttcgtaaatattataacttatagatattttaatatctatatttattattcaagttttttaccatattatataaaaattattaaaacacattatatgttacataaaatactttaatatacaatatgataaaaactttatattactctttatttagctctgctacctgcaatttgctcttgaatattctttggaacttcatcatagtgatcaaataccattgagtaaactcctctaccttgagttctagatcttaaagtagtagcatatccaaacatttcagataatggaacaaacgctctgataacttgagctccattaagagcttccataccttccattatacctcttcttgaattgatatctccgataacatctcccatgtattcttctggaactgttacttcaactttcatcattggttcaagaagtacagggcttgctttagacattgcattcttgaatgccatagaacctgctattttaaatgccatttcagatgagtcaacttcatggtatgaaccgtgtactaacttaactttaaagttaataacattataacctgcaattataccatttttagatgcttcttgaatacctgcatcaatagctggtatgtattccttaggaatagctcctccaacaacagcattttcaaatacatattcaccttcagttggttccatttcaattacagcatgaccgtattgtcctttaccacctgattgtttagcatatttagcttctgctttaacagctgatctaattgtttccttataagcaacctgaggtgctccaacattacattcaactttaaattccctttgaagtctatcaacaattatttctaagtgaagctctcccatacccgcaataattgtttgacctgtttctgtatcagtccaagtcttaaatgtaggatcttcttctgctaatttagctaatgccatccccatcttttcttgagcatcttttgtctttggttcaatagctactcttataactggttctgggaactccatagcttcaagaattattggactattttctgcacataaagtatcacctgttgtagtgttttttaatccaattactgcaccaatttcccctgcttctaatgattcaacttctgatcttgaatttgaatgcatcttaacaagtctaccgattctttctttcttaccttttgttgagttaagaacatatgaaccactttgcattactccagaatatattcttgtaaatgctaatttaccaacaaatggatcagtagctattttaaatgctaaagctgataatggttcagagtctgaagaatttctatgatcttcttctccatctaatgttgttccttttattgctggaacatctaatggtgatggtaagtaatctacaactccatcaatcatttcttgaacacctttgtttttgtatgaagaaccacaaatacaagggtatatttcgttagcaattgtagcttttcttaaagcagcttttaattcttcaattgtaagttcttcaccttctaaatacttttccattaattcttcatctgtttcagcaatagcttctatcattgctgctctgtattcttcagcttgatcagcatattcagctggtatagcttcttctctcatatcttttccaagatcatcatagaatataaaagcaacattctttataaggtcaaccattcctttgaagccttgttcgctacctactggaatctgaatcggaactgcgtttgcttttaatctatctttaactgtttgaatacatctaaagaaatcagcacctgttgcatccattttatttacataaatcattcttggcacaccatacttatctgcctgtctccaaacagtttcagtttgtggttcaacaccgctctttgcatcaagaactgtaacagctccatcaagtactcttaatgatctttcaacttcaactgtgaagtctacgtgaccaggagtatctataatattaagttcatgttctttccagaaacatgaagttgctgctgaagtaattgttatacctctttcttgttcttgaaccatccagtccattgtagcttcaccatcatgaacttcccctattttgtgactcactcctgtatagaacaatatacgttcagtagttgttgtcttaccagcatctatatgagccattataccgaagttacgaaatttatctaaaggatattttctagccatttatttgtcctcctctcaatgagtaaaatataatttaatttgacaaaactgccttagcataagccaaaacagttttatagatattagtatctgtaatgagcaaatgccttattagcttctgccattttatgagtatcttctctcttcttaacagctgctcctgtattattagatgcatctaataattcaccagcaactctttcactcattagcttttcgcctctttttctagctgctattaacatccatcttattcctaatgtctgtcttctttctggtctaacttcgattggaacttgataagtagcaccacctattcttctagctttaacttctagtaatggcattacattgttcatagcttcttcaaatacttctaaagcttcttttccacttctttttgctattaatccaaatgcttcatagcatatcttttgggctacacccttcttaccatcttccattatactatttataaatttagtaacaacctttgaattgtatactggatctggtaatacgtctctttttgcgatatgtccttttcttggcacttttcttccctccttaacattttaaatttaagttcatcggtactcggtatttttcataccgtaaagtgctacatcttttacatctatataaactcaaaataaaatctataatttctgttgaagataagcactattctttgttaaaattcctatttcttcttaggtctcttagcaccgtactttgatcttccttgtaatctgttagctactccagcgcagtctagcgcacctcttacgatatggtatctaacaccaggaaggtctttaactcttccacctcttataagaacaacactatgttcttgtaagttgtgacctactccaccaatatatgcagttacttcaaatccatttgttaatctaactctggcaatttttcttaacgctgagttaggttttttaggagttgttgttttaactactgtacatacacctcttttttgaggacactctttaagtgctggtgcagttgatttaactactgctgtttttctgccttttcttactaattggctaatagttggcattttttcacctcctgaaatttatttatctattttaaaattaagataaacactaatttatcaagttatatgaattagtatatcatacaacttatcaaatatacctaaattttacacaataaatcaatatcctatgtattaagctataaatttacttttataaaatgatatattcacattaatttgtgtgatttcacatttaaaatcacacaaattgtattttatcatttaattttacacatgtcaatataatacatgcttattcttcaacagtttctccaatagtttcttcaactaattcactatctgtttccacctttaaagatctatatctcatcattccagtaccagctggaataagcttaccaattattacattttcttttaatccaactaaaggatcaacttttcctttaattgctgcttctgttagaactcttgtcgtttcttggaacgaagctgctgataggaaactatcagttgctaatgctgccttagttatacctagtagagtttgttctccttttgcttcttctccaccaaattctcttactctagcattttcttcatagaaatcaaacatatcaatcatagttcctggtaataaatccgtgtcacctgaatcaacgatttttatctttctagtcatttgtctaacaacaacttctaagtgtttatcattaatatcaacaccttgtagtctataaactttttgaacctctgaaagtaagtatcttctcgctccatctattccttttatgctcattatatcatgaggatttaccgaaccttctgtgatttcatctccagcttcaacataatcactttcattaactctcaatcttgatccaaaaggtatatcgtagctacgttcttctccatcggcacccataactattactgttcttttctttttagtttcttctattctcgcagtaccagcaatttcacttactattgcaagccccttcggttttctagcctcaaatagctcctcaactctaggtaaaccttgagtaatatctgctcctgcaactccaccagtatggaatgttctcattgtaagctgtgttcctggttctccaattgattgagccgctattattccaacagcttctccaatatcaatctttttagctgtcgccatattcataccatagcatctagcacatacaccaactttacacttacaagtgaatacggatctaatcttcactttcttaattcctgcagaaactatcttatcagcggcatatggatccatatattcattcttcggatgtaatacatccccagtttccggatcaacaatatcttctgctgtatatctaccaattaatctttctcttaattcctcgataacttcgttaccttctttaatttcacttacaaatattccttcatctgtgccacaatcttcttctcttacaataacatcttgtgaaacatcaacaagtcttctagttagatatccagaatccgcagtctttaaggctgtatctgcattaccctttctagctccatgtgttgataagaaatattctattacatctaatccttctttaaatgatgcccttataggtaactctataatcttacctgatggactggccataagacctctcataccagctaactgcttgatctgagattttgatcctctggctccagaatcagccatcatatatatcggattaaatttatcaagactatccattaatgcattggctacatcttcagttgtctgagtccatttttctataactctttcatatctttcttcatcagatatgaaacctctcttatacatcttttcaatcttttcgatcgtttcatctgcttccttaagtaaatcatatttcacttttggaactattatatctgatgaagcaactgttacagccccgattgatgaataatgataccccaatgctttaatattatcaagcattatagatgttttaaccggaccatgcttcatataacattgatcgattatctttcctaacgactttttcgtagctaagaaatcaacttctagattaaatgattcttcttcattttctctatttactaatccaagattttgtggaattgattcattaaatataatctttccaacagtagttttaataatcttagatttcaattctccatcgacttctctaaacattctaacatttatttgagcatgtatgtcaatttctttaacttcatacgccattatagcttcatctttgcttgagaatgtcataccatcgcctttagctccatttttatccattgttaaataatatgatcctagaatcatatcttgtgtaggtacacaaaccggtttaccatctgatggttttagaatatttgttgcagctaacattaaaaatctagcttcagcttgagcctctactgataatggaagatggacagccatttggtctccatcgaagtcagcattataagctgtacatgctaacggatgaagttttattgctctaccttctactaatacaggttggaacgcttgaataccaagtctgtgtagagtaggtgcacggttaagtaatactggatgatctgcaattacttcttctaatacatcccatacttgtggtaatactctctcaaccattctcttggcactctttatattatgagctatgccatcttgtacaagctttttcataacaaatggtttaaataattctattgccatttccttaggaagtccgcattgatacattttaagttctgggccaacaacaataaccgatctacctgagtagtcaactctcttaccaagtaagttctgtctaaatctaccctgtttaccttttaacatatctgaaagagatttcaaaggtctatttcctggtccagttaccggtctgcctcttctaccattgtcaataagagcatctactgcttcttgaagcattcttttttcatttcttacaattatatctggagcgcctaaatctaataacttctttaatctgttatttctgtttattactcttctatataaatcatttaaatcagatgtcgcaaatcttcctccatctaattgaaccataggtcttaaatccggtggaattactggtattacatttataaccatccactgtggatcattacctgattttctaaatgactctacaacttctagtcttctaattattctaactttcttttgtcccgaactttgctttaattcttctttaagttcttttgaagaagttactaaatcaatttcatttagtaaatcttgaattgcctctgctcccatgcctgctacaaagctttcatcgccatatttatctacagcttctctatattccttttcattgagaagttgtttctttaataatggtgtttccttaggatctatcactatataagatgcaaaatacagaactttttccaaagctcttggcgacatatctaaaattaatcccattcttgatggaattcccttaaaataccaaatatgagatactggggcagctaattctatatgccccattctttctcttcttactttagcttttgtgacttcaactccacatctatcacaaactatccctttatatcttactctcttatactttccacagtgacattcccaatctttcattggtccaaaaattctttcacagaataaaccatctctctctggttttaaagtcctatagttaatagtttctggttttttaacttctcctcttgaccactgtcttatttgttctggagatgctaaaccaatttgtattgcatcgaaattatttaattcaaacaagggtaaatcctcccttcaaaattagtgttcatcattaaaatcatctagttctaattcagtttcaagatcagctatatcgacactttcatcataatcaatttcatctatgtcttcatcattattttgatcataactatcatcatctaatacatctggttctggcaccataatctcttcagtgccttctatattaacttctagatttgccatatcttcatcaacaaattcctttaaagttacttcttcatgctcatcatttaataccttaatatctaagcataatgcttgtagttccttaataagaaccttgaatgattctggaacccctggttcaggtatattttcaccttttactatagcttcatatgttttaactctacctacaacatcatctgatttaacagttaatatttcctgaagtgtatgtgctgctccatatgcttctaatgcccaaacttccatttcaccaaatctttgaccaccaaattgagctttacctcctaatggttgttgagtaaccaatgaatatggtcctgtagatctagcatgaatcttatcatctactaaatggtgaagttttaaaatatacattataccaacagttactggattatcaaacggttctccagttctaccatcatataatatagttttagcatcttctctaaatcctgcttttatcatgcattctgtgatttcaggttgtgttgcaccatcaaatacaggtgtagctatatgccatcctaaatgactagctgcccaacctaagtgaacttcaagtacctgacctatattcatacgagaaggtactcctaatggatttaagcatatttgaagaggtctaccgtccggtaagaatggcatatcttcttctggtaatattctagagataacccccttattaccatgacgtcctgccattttatccccaactgaaatttttcttttttgtgctatatagcatcttacaagttcatttactccaggattcaattcgtctccattttctcttgtaaatacttttatatcaacaattattccagcttctccgtgaggaactcttaatgaagtatctcttacttctcttgccttttcaccaaatattgctcttagcaatctttcttctgctgtaagctcagtttcaccttttggagttacttttccaaccaatatgtctcccgatctcacttctgcaccgattcgtatgattcctctgtcatctacatccttaagtgcatcatcgcttacatttggtatgtctcttgtaatttcctctggtcctagcttcgtatctctagcttcacattcatattcttctatatgcatagatgtaaagacatcttctctgaccaattcttctgaaattagcatagcatcttcgtaattataaccttcccaagttatgaatcccattctgatgttcttacctaatgcaatttcacctaaatctgtagatggaccatctgcaataacttgattcttgtatactatttctcccgtatcaactatcggtctttgattaatacaagttcctgagttacttctcttaaactttaataatttatatacatctgtgccaccatctgagtctctcttaacacgaatctcactacccgaaacataagtaactactccagcattctttgcctttggtaatacccctgagtcaacagcagctttaaattcgatccctgttccaactattggtgcttgaggacttagtaatggaactgcttgacgttgcatgtttgaacccataagagctcttgatgcatcatcattctcaaggaatggtatcatcgcagttgcaacagatacaatttgtcttgcagatacatctattaaatcaacatcagttgttggaacaactaatatatcctctaaatgtcttactctgacctttttatttataaagtgcccattttcatccattggctcttttgcttcagctattaaacattgatcttcttcatctgcagtgaaataccttatttcatctgtagctcttccattttctttatcaacaattctatatggtgtttctataaatccatactcattaacttttgcaaaagtcgccaaagaatttataagccctatatttggaccttctggtgtttcaataggacacattctaccataatgcgaatggtgaacgtctcttacttcgaaaccagctctttcccttgaaagacctcctggtcccaatgctgacaaccttcttttatgagtaagttctgataatggatttgtttgatccatgaattgtgataactgcgagctaccaaaaaattctttaatagctgctgctactggtcttatattaattaacatttgaggagttatagcttcttgatcttgaatagtcattctttcctttactactctttccattctagatagaccaattctaaattggttctgcaataattctcctacagatcttaatcttctattgcctaaatgatctatatcatcaacataacctattccataagttaatcctaattcatagcttatagttgcaaatatatcatcccttatgatgtgtttaggaataagtttactaatattcttcttaatttcctctttaatacttgcttcatcagaaaaattatccaatatttctttcaaagttggataatgaaccaattcttttattcctaggtctgaaatatcaaaggaaacttgtttctttaagtctacaaagttattactaattactctaataactttatcttctattaatacatcaacagatttaacacctgcattctgaatttcttcagctactaatctacttattttctgacccttctccaccattatttctccggtttgtggattaacaatatcagtggccgctacttggttagctattcttaggtttaatgcaagttttttattaaatttgtatcttcctactctagataaatcatatctttttgcatcgaaaaataatgtatcaattaaagatatagcactatctactgttggtggttcaccaggtctcaatcttttatatatttcaagtagtgcttcctctttagttttagtgttgtctttttctattgaagctctaaatctttcttcttcaccgaagaaatctaacaactcctgatcactgcctaatcccatagctcttgccaatatgctaattgataattttctagttttatcaattcttacataaattacatcattagaatctgtttcgtattccaaccatgctcctctattaggaataacagttgatgaatataactttttaccactcttatctatagagtagttataatatacacccggtgatcttactaattgactaactataactctttcagcaccattaattacaaaggtaccttgctctgtcattaatgggaagtcacccataaatacttcttgttctttaatttcaccagtttcattattctgcaatctgattgaaacttttaatggcgcagcataagtcgcgtctctttccttacattcttcgacagaatacttgatgttttccatatcaagtttatagtctacgaactcaagtactaaatttcccgtgaagtttgtgataggattaatatcatcaaaaacttcatgcaacccttctcttaaaaaccattcatacgaatctaattgtacttcaattaaattcggcatttcagtaacatcattaaccttaccaaaactcattcttgttctttttccaacttggacaggatgtaccatgaattttcaccccttgtataaaataaactaaaatagccaaaagcatactttccctaaggactttgctttcggacagcgtctttctatagtataaccattattcaccagattatactccttatttccactataaatatatagtattccatagagaataatacattatattataatatcataggatatttttcttgtcaataaatattattgaataattcttttcagttataaagctatataaaatacctatttacctaacaagcattttatatagctttataaattcagtttaaaaaaggtgctataaagcacctttttctttaaaacaaactacttaacttctgcagtagctcctacttcagctaatttagctttcatatcttcagcttcgtctttagaaacgccttcttttaatgtcttaggagctccatcaactatttccttagcttcttttaatcctaatcctgttatttctctaactactttgataactttaatcttgttatctcctgcgcttgctaatactacgtcgaattcagttttttcttcagcagcagctccaccagctacagctccaccagctacaacagcagcagcagcacttactccaaattcttcttcacaagcctttactaattcatttaaatctaaaacgctcatttcttttattgcttgaattatttcttctcttgtcatttttaatagcacctccgaattttttttttaaaattttagttaatctttaaattattctgcagactcagttcccttgctatcagcaatagcacttaatacacgtgcaaagcttgatattggagacttgatacttccaagaagttttgcaataagaacttcttttgatggtattgttgcaagttgtttaatcttagcttcatcatagatttctccttctatgataccagcctttaattctaacttcttgtgatctttagcaaaatcatttaaaagtcttgcagctaatgttacatcttcataactaaatgcaatagatactgcaccttctaaatattctgctataccatctaagcctaattctttagctgctaaagttactaaagtatttttatatactttgtattcaactccagcttctcttaaactttttctaagagctgtatcttcttcaacatttagaccttgatacttactaagaacaacagcttttgatttttctaatttttccttaatttcagcaacttttgcttctttaagttctctgtttttattcattactgtagtccacctcctcacagttcaaactgcttcttttattaaaaaagaccttccgcagacatggaaggcctataatacaatctattatatacctaggcgggcagttatactttacgctttcgcacccactgtctacggaaaaaatattttctttttacaacatttgaaattatactacataatttcaattaagtcaatactaatctaaagctcttgtaggattaacttttgcacttggtcccattgtgcttgaaacagatactgattttaagtattgcccttttgctgctgctggtttagccttaactaaagcttccattaatgcagtaaagttttcttttaatttttcagttccaaatgattttttcccaattggacagtgaactattgctgttttatctactctatattcaactttaccagctttaatttcttcaattgccttagcaacatcaaatgttactgttcctgactttggatttggcattagtcctttaggtcctaacactctaccaattctacctacaattcccatcatatctggtgttgcaacaactacatcataatcaaaccagttttcgctttggattttttgaactagttcatctgctccaacgaaatctgctcctgcttgttgtgcttctgcagccttatctcctttagcaaaaacaagcactctaactgttttacctgttccgtttggtaatacaactgcacctctaacttgttgatctgcatgtcttggatctactccaagtcttacatgtaattcaatagtttcatcgaagtttgcctttgcagtctttaatgtaagatctaatgcttctactggattatataatgcactcttgtctataagctttgcactttcaatgtatttttttcccataatttgcctcctctgtggtattaacggttttgacctcccacttatttttacgaattactcttcaatagttacgcccatacttctagctgtccctgctatcattctcatagctgattcaagacttgcagcatttaagtctggcatcttagtttcagcaatctttttaagttgatcttgagttaatttaccaacctttgttttattaggtactccagaaccactttctaatcctatttccttcttaattagaactgcagctggaggagtctttaatataaaactaaaagatctgtcttggtaaactgtaataactactggtattatatacccagcttgatttgcagtttttgcattaaactccttacagaatcccattatatttacaccgtgttgacctaaagctggacctacaggtggagctggtgttgccttacctgcttgaagttgaagtttaatcattccagttactttcttagccatttttgttattcctcctattactgtggtataacgaactctttttagttctcccacttaattaaaattagttcattatagttaaactaatttttcaacttgattaaagtctaattcggcaagtgtttctctgccaaacatctccactaaagctttcactttgcgtttatctggaattatctcttgtattgtggctactgaatctctcaatggcccagagataattcttatactttcccctacctctaagtcaatctcaacaggaacttctaacactcccatcgattccacttcttcatcagaaagaggaactggtttagatcctgggcctacaaatcctgttacgcctctagtatttctaacaacgtaccaagcttcatctcccattaacattttcacaagcacatatccaggaaatttcttctttaatgagactttttgctttccatctttttcttcaaccacttcttccatgggtacttgtatatcatggattaatgcttcaagatttctattttcaattgctttttctaagtttgcttttaccttattttcatatcctgagtatgtatgaactacataccatcgtgctctatcactcatattcgtcaggcgatataaaatcacccaaacctcccttttacttgaaatttaaaatcattttaaagaggttattgaaaatagaatccaatccaccaactaatatagtatacattagtgtgaacacaataactgcaacaaatgctttctttgtctcatcttttgaaggccaagttattttcttaacctctaccttaacctctcgaaaaaaaccaaacaaaccattacttttaatagttttttcagtttttacactgttctttgctgacatatcttcacatccttaaatttaataactatatgtcattacttcggctaattactttgtttctctatgaagagtgtgctttttacagaatttacaatactttttcatttctaatctatctggatcattctttttgtttttcattgaatcataatttctttgtttacactctgtgcatgctaaagttacttttgttctcatgactgcacctccagttttcttatatattaaataggaatcttgagttcctattcacttctaaaatttacgttgcttaaaatgtcacttttatacaatatcatagaatatttgacttgtcaatcatcctttaaataggactaagttatataacttagtcctattagtaataaatgtatcttattctactattttagtaacaactccagaacctacagttcttccgccttctctgatagcgaatcttaatccttcatccattgcgattggagtgattaattcaacattcatatcaatgtgatctccaggcattaccatttccattccatctggtaacttgattgatcctgtaacgtctgttgttctgaagtagaattgtggtctgtatccatcgaagaatggagtatgtcttccaccttcttcttttttaagtacgtatacttgacctacaaatttagtatgagggtgtactgaatttggttttgataaaacttgacctctttcaatatcagttctttgaactcctcttaataatgctccgatgttatctccagcttgtgcttcatccaataactttctgaacatttcgattccagttactacaactttcttcttttcttctgttaatccaacgatttctacttcgtctcctacatgaagtactccagcttcaactcttcctgttgcaactgttcctcttcctgtaattgtgaatacatcttcgattggcattaagaatggcttatctgttgctctttctggagttgggatatagctatctactgcttccattaaatccatgattggcttaatcgcttcttcatctgttggattttctaatgcttttaatgctgatcctgttattactggaatatcgtctcctgggaagtcatattcgcttaataattctcttacttccatttctactaattctaataattctggatcgtctaccatatctgctttatttaagaatactacgatatattggataccaactcttgatcctagtagtatatgttctcttgtttgtggcattggaccatctgctgctgatacaactaagatagctccatccatttgtgctgctcctgtaatcatgttcttaacatagtcagcatgccctggacagtcaacgtgcgcataatgtctgttttctgtttggtactcaacgtgtgctgtattgattgtgattcctctttctttttcttctggagccttatcaatatctgcatagttaaatgcttctgcaaatcctttatttgctaatactgttgtgattgctgctgttaatgttgtcttaccatggtctacgtgacctattgttccaatattaacgtgtggcttacttctttcatactttgcttttgccattataattttcctcccttattatcttctaataaacttggcctagtgtttttttattttttattatttggagctcacaatcggaatcgaaccgacgacctccaccttaccaaggtgacgctctgccgactgagctatgtgagcgttcaaaattgctatcttctttgatataccaattataaagtttactattattctttttatttgtcaatataaattatcactttaaatctaagcatttttctaattttctctttactctttgtaatgcattatctatcgacttcgaatgtcgttctaaatcacttgcaatctcctgataagattttccatctaggtatgaagtaagaacttctaattccaaatctgataacactttcgaaatctttttctcgatataatccatttgttccttactaatcattagctcttcaggatctgaaattttcaatcctgccaaaacatcaaggagagttctctctgattcctcttcatatattggcttatttaaagagacataagtatttaacggaatatgtttctgcctagtagctgtttttattgcagttattatttgtctgattacacatatttctgcaaaggctttaaatgatgttgatttttctgcattaaaatctctgatagccttatataaacctatcatcccttcttgataaatgtcttccttgtcggctccaattaaaaaatatgatttagccttcgacttcacaaagttctcatattttgaaattaaatattcttgcgccctactattaccactcttagctttcgcaacaatttcttcgtctgatttatctttgaaatctaaaaaacctttcaactgcttattctcaactctcttctgcattaaactaaccactcgtttagacaattataccccagtaaaattatgttagtcaactgaatttacttacttcttctgatttcttctaatattttgactatcctatcatctatattatcacttattatatttttctgtgaaattctgttcttatctgctttattttttatagacttctctatccttagaacctcattataaaattctaaagatgacattctaactgcacctctttgaaaaattgtttgctgctctaggctatcagatgttacaacaactatttcatgtttccttcctagagcatttacttgtttctcaatataactatccgcagtttctccatcctttgtaaatactactgatatatttctatttacctcttctttcttttcaatgctcccagtaactttatgagcatcaaatactaatattattctacaagcattaaaaactccataattatgtaaagtatctataagagtttgtcttgcaccctcaaagctagaatcttttttttgttttaaattaggccaactatttataacattatatccatctacaaaaatagttttcacgatatacctctctctatttcaatcgtccttttaaaacttcatacataattataccaccagctacagatgcgtttaaagaattaatctttccgaccattggtatttttattagcttatcacacttttccaccgttaattttgaaatacctcttccttcatttccaattataactgcacaaggtcctccaaaatctacttggtagctatattcttctgcccttatgtctgccccataaatccagatccccttttcttttagttcctctattgtcgaatttaaatttgttactttagctatttttacatgttctattgctccaaccgaagatttataaacggttgtacttacagatgcacttcttctctttgggagtataattccatgaactccaaataattctgcagttcttactattgatcctaaattatgcggatcttcaacctcatccaatataactatgaacggagcttcccctcttttctctgctaaatccaatatatccgatacttctgaatatttatatggagttacttttgctattaccccttgatgtacttctccaccacacattgaatcaagttttcttttatccacttcttttattaatattttattttcttttgccaaaccaacaatagtttttattgaaccttctaatttactattagatatatatagtgcttcgatcgttctttctcctcttagagcttcaattacagcatttcttccaataactatatcttctctctcttcaatggcgcttgttgatttatcatttcctaccatattatctttcttatttttattttttacctgattatagcttttagctttaccttttgattcagttacagatttatctttatcttccataaacttgccacttgaaatatttcttttcagtttactattcattataaaccctcctttttttaattttatacactaattaataatttcaatacttctatcaaatataaattctaatctttccttatcccccactaggtatagataaccaattaatgcttcaaacccagtcgccattctataatcccttatctctgcatttttaggtacagtaggtgatttcgcatttcttcctcttttataaaccgcttcttcctcctcatttaggagattctcaatttcatgcattatacacgcctgactttttgcttttacatatccaattgccttcacatgtatcttatttgcagataacgctgtattttgagtcaaaatataatttctaataaaaacttcaaatacaccatcacctattaatgccaattgtaatgaattcaacattcttgcttcatcttttgaaaattttctaattcttaagtcatctaacattataattctcctttaaataagggttgcaaaaatgcaaccctttctttaattaatcaatctttttccatctaacaccctgtggtgtatcttccaaaattatatttctgctttttaaatcatctcttattttatccgcaagtgcaaaatctttattttttctggcttgctgtctcttttcaataagctcctgaatttctgtttccaaatccttctcaatacgatcttgaagtatacctagcggatttcctagttctctaaccatcgattctgctttctcacataattcagaggatgaattaatattcacattattgttaatatctttagtcaaatcaaacaatactgaaatagcatctgctgtattaaaatcatcatccatcttctcaataaatttttctctatatttatctaaagactttagatatttttcttccgcttcatccattaattttttagtcacttcatctttcaaattttcaagattatttatgcaattatataatctttctattgatgattttgctgaatctaaaagttctttagtaaaatttatttgtattctatagtgtccagacaacatcaagaaccttattgcatccgaactatattcctcaagaacttctcttgcggtaaagaagttatttaatgattttgacattttcttattatctacattaacaaatgctgcatggagccaataatttgcaaatgtttttcctgttagagcttcactttgagctatttcattttcatgatgcgggaatcttaaatccatgccacctgcatgaatatctattgtatctcccaacaatttcttcgccatgcacgaacactctatatgccacccaggccttccaggtccccaaggactttcccaagcaggttcacctggcttttgtgctttccatactgcaaaatccataggatctttctttctttcatcaacagatattcttgcaccaacctgcaaatcatctaagttctgtcctaccaatcttccataattatcaaatttttttgtgctatagtaaacatcaccgtcaacttcataagcaaatcctgcttcaatcaactcttcaacaaatttgattatatcatgaatatattctgttgctctaggatttacagtggctctttcaatctttaatgaatcggcatcttggtagtattcttttatatatttatctccaagctcttttactgtaattccctcatcattagctttattaatcattttatcgtctatgtcagtaaagttttggacaaatctaaccttatatcctctatactccaaatatctccttatagtatcaaatacaataaatgttcttccattacctatgtgaaaaaaattatatacagttggcccacagacgtacattttaacttcgccagtaataatagggataaactcttctttttgtcttgttaaagtattaaataccctcattaatttacctcctaaaattattttagttttattttgtttttctcaaattcaccttttattatattataaacatcttctattttgattacttccatttctccatctctaagtttaaattcaatttctccatcattaatctttttacctactgttattctcattggtattcccattaattctgaatctttgaatttcactcctgctctttcatttctatcatctaaaagagcttctattccagcacttgttaatttttcataaatttcatttgcaattctagcttgttcctcatcttttacattaacaggaattacagaaacatggtatggtgcaacagacaatggccatactataccattctcatcatgatgttgctcaattatagatgccattgttcttgtaactccaattccatagcatcccattataaatggcttttcttttccatcttcatctataaacttagcattcatggcttccgaatatttagtaccaagtttaaatatatgccctacttctgttcctcttgcaatagtaaccttaccaccgcaaactgggcacttttcaccttcagttacgtttctataatctcctattacaccttcaaagtctcttccataattcacattattaatatggtaacctgtttcattagcacccacaataaagttatacatattagcaacttcttcatcaactaatagcatatctacttttatccctattggtcccgcaaatcctatttctgctcccgttgccttttttacatcttctgaactagcaagctctagattaattacttcaccaattgcattgctaaccttaacctcattaatttctctatcacccctaaccataactgctactattttgccatctgcattaaacaagatagtctttgcgaattttttttcattagtaccgaaaaacttaaccaattcatctatagtttttgtattaggtgtctcaactttatttatttccttgaattcttgttttaactctttctctgctggtgatgaagctttctcgatatttgctgcatagttacattcactgcaaaataccacatcatcctctccaacttccgatttaaccataaactctgctgaatttgaaccaccaatagcaccagaatcagcagcaacacattttgcatctaaaccacatctattaaatatttttacatatgcatcatgcattttatcataagctaaatctagcccaccttgatctttatcaaagctataagcatccttcattacaaattccctagatctcatcactccaaacctaggtctacgctcatctctatactttgtttggatctgatataaattaagaggtaattgcttgtaagacttaatttcatttctcgctatatctgtaaatacttcttcatgagttggccctaaacagaaatctctatcccctctatcctttaatctaaacatttctgctccatatgcatcccatctaccagattcttgccataattctgctggaataatagctgatgctagaaattcctgcgcacctgcggcattcatttcttccctaattatatcctcaaccttttttaaaacttttaatccaagaggcatataattatatactcctgcagccattttccttatcattccagctcttaacataagcttatggctatcaatctctgcttccgctggtacttctcttaatgttgatattaacatattagacattttcatttggtgttcctcctaaataatattggttagattgcaaataatattttatatatgatgtaataaaatctgaatatttgattttacaaataattaatagtttaaaaatatataattggataaataaaaaagcccgcctaatatatatattagggcgaactttatatcgcggtaccacctaaatttgttctctagcaatgataacggttttagaccgatagtttttccctatactcaaaagctggttcaaagcctgtttaaaagtctttcagcccacggactttttctcttatataatcgacttctactattcttcatcaacgttttacaatcttaattaaattttattttaatatattataacttcctgaatttagcctgtcaatacattattactatactatatttttcacaaaatactctgcaagtattaaatcttccggtgtagttatttttatatttttataatccccctcataaatataaactttatgtcccaaaagctctactacactagtatcatcagtaactgatatacatcttttctttatttctttatggcattcatatattaggttaaaatcaaaagcttggggcgtttgaattgcaacaagttcacttctaactaaagtatctactgaaaaattattactatctttaatttttatagtatctttaggcataactccaggcgctgcagctttataacgcttagcatattcaaccgcataatttattattttctgagatacaaatggcctagctccatcatgaattaatactatatcggatttttctaatttctccaaagcattatatactgattcttgtctttcattcccaccagatactaaatcatctatttttaatccatatttatttaatacttctcttttacaataatctttttcatcttcaggcactactaaaatgatcttatctatcaaatcattttctataaactgctttaacgtgtaataaagaatgggcgcaccattcaaatcaatatattgcttgctttgaatattgcccattctcttacctctgcctccagctaatactatcgcactaaccatacagaaaactctccttaacttttaattatcttttggttttgcaaaaatcattcgtccagctgctgtctgaagaactgatgtaactataacacttgttgtttgtcctatgtattttcttccaccttcaacaacaatcatagttccatcttctaaatatgcaacaccttgacttgattcttttccatcctttactatatcaattgtcatttcttcaccaggtaatactactggttttattgcattcgataattcatttatatttaataccggtactccttgaaactcagccactttatttagattataatcattagttataacctttccttccatcttttgtgcaagtttaagcaactttgcatcaacttctgcaattttaggaaaatcatcttctacaatttgagtttctatggctagctctttttgtattttatttaatatatctagacctcttcttcctctatttctttttagtgaatcagaagaatcggatatatgccttaattcatccaatacaaagttaggtataaccagtggtccttcaacaaatccagtctcacaaatatcaaatattcttccatcaattataactgatgtatctaatacctttggaattccttttatagattcttttattacctctttaacttttttctctttaattacaggctttttcatattaacaagaagagctgttatatcttccttttttttaatcattatttcagcacctattatagcagctaacacatttaataaaattaataaaattggcccaattatatttatatcatttattggttttgcaataaatgtcataagaattaacgcaattacagctccaaaagttccataaatgatttcagttatgctcattttttgcatactcttttcaatatactcaattaaattagaaattcctttgtatataataggagaaataatataaaatataagtccaaagataaaagatataataataataaataaaactctagtaatagtggttgaaatgtaagttaaattatcaacctgagggattgtaagtaatatttcagatatgaaatatcctagtatcaatccaattacagaaaaaattccccttaatagtctttttaacacatacttcacctccttctaattatttacaattagatagtattttaatcattttttcaacatttctctaaatcatattaattatatcatacaataagtacctctaaaatgaataaattattaagtttactaataatttcattctactttgaagaatcaacttaaatcttagatcaataaatctaaataaatggtattttctttgtaaaaactaaatcctatttaatttaacacaaatttaattatcatatttccttttttaatgaaacttgctcttttatacgtttcaatccatctttaatggcagtagctctagcttctcctattccttcaacattatctaagtcatttatatccgcatcaattatattacttaattcttcaaattcttttataagattatcaataacattagatggtattcttggcaccttactcaacattctatatccctttggagatattaatgtatccataagtggaattcctccacgacctaatgttcttgcaactgcgtctaattctaataattctgaagaatttaatttttgaatgtgctcatatacctcgttatattgaagtccatctttacagtaatccctaattagcaatattccatctctttctatatgcttaactaattcatttaattgcattgatattaatcgtccttcattccccaactctagtatatacatattaatttcttccactattctcattaccatttcagttctttgaattgctgtaactacatcgaatagtgttgttaagtcttgaaactccaataaattcaagttattaataacacgttcaagtactgcaacatatttttctagtgtttgaagtgcttgatttgcctttccaagaattacactactttctcttaatacatactttatatcacccttgtacatagttattatatttcttctttgagaaattgcaattactatgttattcgtttgcttagctactctatgcgccgttctatgcctagttcctgtttcatatgttggaatagatgaatcaggtattaattgcgcattagcacaaacgattttctttaagtctccagttatgactatagctccatccattttagctaattcgtatgcatatgatggtgtatactctgaattaatataaaaaccgccatcaacgagtttcataacttcttcatcgtcaccaatcactaataatccacctgttttagctcttaatatattttcaagaccttcccttagttgagtgcctgggcacattatctttaagacattctttattcctattcccttttctattctcatacactcacccattttctttaaaaatcattttaatacttttctagatctatttaaaatcaaatattaaacattttgactgatattattttccgagtaaatttaacctaggctctagaaactataatactataataaatataatccctcaacaacatttgttaaatttaagttataatatatttatttgtaagaaatagctctatcctcttcatatttaatatggaatttctataatgttctagcttctataaatattatttattacatccatcaaagtctttaattcaattatatctattttctttaagttactgctttttcctatagaatcctttggaacataaacctttttaaatcccattctctcaagttccctaatcctactttctaatgatggtacttttttaagttccccagtcagtcctacatctgctataaacgctatatttgattctatcccctgctgctttactgaggatactatactcattattacagctaaattaatgccctgttctcttatttttataccacctgtagttttaataattacattcttatcgtataaattaattcctccacgttgttcaagtatagatatcaaagtgtttaatttatcctttcctaatgtttcccctattcttgtaggatacggagtaaaactcttcgacactaaactttctatttcagttattattgctcttgttccttctttaattactgttaatgcacttcctgatacaatttctccttcttcacgctttgtcatgaagaattctgaggggttatctattgaaataatccctctctcccccatttgaaagaagccattttcaataccaccaaatctatttttagaacttacaagtactcttaactcttcatcactatcatcttctattataagcaccgtatcaactaaatgttctaaggctcttagccctgcaagttcatcacttttagtcatctgcccaactattataaccgctcttggccttctatcgtttttagccatttggagcaatgcattagcacattccatagtttgtgtaggtgaccctgctctcgctggcaaagatgattccatagtaaatgtttgtatactatctattattataatatccggatctatttcttcaactgcatctaaaacattatcaagacttgtttcttgtagtacccatatatcttcgtggattttattaagaattctgtctgctctgttttttatctgactatcactttcttcccctgacgcataaattactttatatcccttttgggcgacagcatcggaaatttcaagaagaagtgttgattttcccgctcccggtcttgctgttataattgaaattgaatcctttacgattcctccacccatgaccctatcaaattcatttatccctgttactattctatcgcttttgttggaaactatatccaaaagtttttttaacggtttttttgctacttgtctggatctagtctctaaattttttgcttcaatagtaatttcctctaatgtattccaattattgcatgttgggcatttaccaagccactttatactttcaaaaccacaactattacatctatataatgtttttttcttcataaacctctcccttcgtttctagatctttattacatcttacttttttaataataatattaattacattatagcatattactttcttactcatatattttgaattaaatatagctagtgcttagccttcaatcaattattatatatagcactttataactattttattttttgttcttagaatatttaataaattattgcaaaagctattataaaatagattagtaaagaacaaatatataataatatagaaattataatattaatatcaacactagaaaataaatataatatataattcaccagttatgtattaactaaattactctataatgattattctaataatgagacaacaatatataaccaagttataatttaattgataataaacatcattattttctagctatattgaatgattataaaatctatattataatattaattacaatataataactattattaaggaggcgtattcatttatggtaaaagtatatactaccaatacttgtccttggtgcgttaaagcaaaaacttttcttaaatcagagaacattgaatttcaagaattaaatgttcaagatgatatggaagctagagaagaaatgataaaaaaatctaatcaaatgggtgtcccagtattagatattaatgataatattattataggctttgataagcctgctattctaaaggctttaggtaaataattaagaggcgtatatccgcctcttttattttggcttatataaattaatatctgatttatattctcatctttaatgctattttctttttcgtaatatatatttttctgcatttaaaagcgcaatcgtaccatctgatacagcagttgttatttgcctatacttcttttgtcttacgtcccctgctgcatatactccttgaatatttgtttgtaaatcttcatcggtaattatatatccttgttcattcaattttatataatcctttacttcttttgttctaggctctgttcctatatatccaaaaactgcattaacatctaagctactactttcttgagtcttagtgtcttttataataactgattccaaaaattccttaccattggcttgaatcaaatccttatttaatagaacctctattttaggattattgaaaacttcatcaattaatgactgttctcctttaaaataatcataccttcttattaagtacactttttcagcaaacctagttaaaaatatagactcctctagtgcagaatttccgccgcctacaacagcaacttttttgccttgataaagtgctccatcacaaatagcacagtaatgaattcctcttcccgaaaattgttcttcttgaggaataggcagttttcttggcgcagctcctgtagcaattattacagctttaggttggtatacatatgattcagtttctataatcttttcatcatctgatatatatatcttttcaattgaatcaaattcatcaatatttgcgccaagatctctagcttgttcttgaaatatgtcagctaaatctcctccacctatacttttaaatcccgggtaattctctatagtataactgtttctaacttgacctcccacaagttcattttctaacaacaatgtatccaactttgcccttcctgcatacattgctgctgtaagacctgctggtccaccccaattataattaaatctaattctttcttttctttactcatatctattttctcctaatatttaatacattttaaactactcaatacccaaatattatattaatctttaaactaaacagactatttcaatgtataaataatttatagcgttgaaatagcccattaacataaattaattcttattgagctccaaattgctttcagccaatcttttgaaaataagtttgttttctaactcacttacctttaccctatctccaattcttatatttccttgtaatatttcctcacttaatttatcttctacctcttttattattaatcttctaagtggccttgcaccataatcaaggtcaattcctttgtttagcaggaaccttttactattatcttcaaagtttaagtatatatctctgtcttcaagcctttttcttattgatgcaagcattaaatctataatttgatttaaatcttcatcactcaacttatggaatactattgtatcatctattctatttaaaaattctggcctaaatttttgctttaattcccctaatatattttccttcatcttttcatattcagtttcattttcgtttttagaactaacactactaaatcctatgcttttttgctttttaatttgatgagccccaacatttgaagtcattataattattgtattcttaaaattaactatttttcctttaccatcagtaagccttccatcttccataatttgaagcaatatattgaatacctctggatttgccttttctatctcatctaaaagaactattgaataaggttttcttctaacagcttctgtaagttgaccaccttcttcatgtcctacatatcctggaggcgatcctattaatctagataccgaatgaccttccatgtattctgacatatcaattcttataatattattttcatcaccaaacatagcttctgcaagtgctttagaaagctcagtctttccaactccagttggtcccaaaaatataaagcttcctattggtctattaggatcctttattccaactcttgcccttctcacagcccttgctatagatttaaccgcctcattttgtccaacgactctcttgtgtagtatttcctctaattttaataaccgttcactttccgattcagttaatttttgaattggaatcttagtccaagatgatactacactcgctatcttttctgcatctacaactagtgtctttatagaattctgagtatcccaactatctttcatattacctaactgctcttttaaaattctctctttatcccttaaattcgcagctctctcaaagtcttgaactcgtatagcttcttccttttctttacctatattttcaattttttcttctaaatcttttaaatctggaggggctgttaaactttggattctcactttagcagctccttcatcaatcaaatcaatggctttatccggcataaatctatctgttatatacctatctgccaaattaacggccgcttctaaagcttcatctgttatttcaactctgtgatgagcttcatatttatctcttaatcctttaagaatctttagcgtttcttcctttgaaggctctcccactgttacaggttgaaatcttctttctaatgcagaatccttttcaatatactttctatattcatctatagttgtggctcctatacattgaatctctcctcttgctaaagcaggctttaatatattagatgcatcgatagcaccttctgctcctcctgctcctataatagtatgaatctcatctataaaaataattatatctttatctttaattatttcatccatagttttcttaagtctttcctcaaattcacctctatacttagctcctgcaatcatagatgttaaatctaaagaaacaactcttttatttctaagtatctctggaatatttccctccactattctctgtgctagtccttcaactacagcagttttaccaacacctggttccccaatcagacacgggttatttttaattctcctacaaagaatttctaataacctttgagtttcattatcccttccaattacaggatctagtccttgttccttagatagtactgttaaatcccttccatacttatcaagcattggagtattagctttcttattatcaattatatttttatcgctagctttatcttcataagtaccagataagaatacaagtaattcttcacttataatggtgaagttaagattcaagctttttaagatagtgtatgccattccttcttcttgattaagtaaggccaataaaatgtgttcagggctaacatatttatgatttaatctttttgctgctgcgaaactttcatctattaaccttttggtccgaggggtcagtaaaatattatcgtctgttttcttgatatccccataacccaagtatctttgtatcatatttctaatattctcaatattaaccccatatttttttaataacttagcagaatatccatcttcttttaatatgccaagtaatatatgctcagttccaacatacccatgtttaaatttttctgattcattttcagcttctaaaattactgcttgtgccctttctgttaatttattatattccatatactttaaacctcctatcttctccttaggttaacatttctttcactaatttagctctttcatacttaatttccttatcatctagtgattttttcaaataattttgaagggatgaattagtaattagaataaatagtttatctaacttacccttatcaatatttataattgataattccgctcctaatctaacatttgataatagttcaatagactctttaaaatccaaaatcattgcatatttcagtattccatatgctctatatatcttatcctctaattcatgtctacatttactaagtaatatttctcggaatttattttcctctattattatgctccaaactgcttcttttaatttatttataatattctcctctgtcaaacctaatgacaccttattagatattctgtataaatttccaaaaacctttgtaccatctaaatgaactccctttatagcaattcctaacttaccaagccttttggatatattattaatttcttcactcatactaagagctggcaaatgtaatactactgaggccttcattcctgttccgatattctctggtgatgctgttaaataacctaatgtttcatcaaaagcatagtcaaaattttcttctatcttatcatcaataactgttgctctctcaaaaatttcttctaatttcaatccatcacttacacattgaagatttatatgatctttttcatttatcataatgctaagatcttcttctttattcaatataaatgagcccttatcagaatttttcaaaagctctttgctaattagatccctttctaaatattgtttactaaattcctcttttgtattccaaatctcatataacgtaatttcttcattatccaattcgtttttaagaacgttatatacttctttgccattttctctacccttaatatagtttagcttattaggaaaaggtaaattactaaagtttctagctaacaatactttgctacttaatactgccccaaatctttccttatcatcttcccagctattcatcacaattgccctcctttctatttataatttccttagtgttactttctaatatatataattctagttttttaatttcatctcttactattgctgctctctcatattcctctgctactatcaatttttgcatctcttcttttaaatccttaagattttttctttgaaccaattcctttccctttaccttaggaatcttaccaatatgtttacttccaacttgtaagctctttatccttggctcaagtacaatattaaattctttataacaatcagtacatcccaatcttcctgatttcttaaattcctgataggttaacccacaatttggacaaataatttcctttactttattattatctatatttgatttaccattatctacattagataatatttctgtaagtatgccttgaaatggaacatttatattttgcattattggattaaagaacggaatattagctatatcttttgcacaattttcacacaaccaaatttcttgtttctgaccattcatcactgtaattaaatttatctttgcttcattttttttacatttttcacataacatatatatccccacctttaagataaaattatcataatcatagcttttaaaatatcagctcttactttatttttattatctgctgaagttaaacttctatcatttattgctattttcattatttcacattctctttcttcaataactccagattctaataagtgattaagcaatgcgtttgcattatgatatgttattgtttctcctatgctttggttaattaattcttcccttctattggagttatcatcatctaactgcttgatcgctatatgacctccgccgcctctcttgctctcaattaaatatcctctttcataggtaaatcgagttgttaatacatagtttatttgtgacggcgcgcatctaaactgatctgctaactcatttctttgtataaaaatcacattatctctattctcattaaacatttgttttataaactcttctattatatctgaaagtcttgccataacatcacctgcttaaacctttatttaattatttgtttttgacttactttgactttataatattatactatactttttttactttttgaagcatcaatataaatttatgattatttataatactgtatgttaataatatctaatatatttcaatttatggaggttttatatgcaaattatttggtatggacattcttgtttccttatgaaaacatccattggtaaaagaattctaattgatccatttagcaacaatttaggttatgataataatttccctaaatctgatttaattaccattagtcataaccattttgatagttcatatattaatgatataaataatacaaccaagattattaatgagagcggaaactttaacttaagcttccttaacatagaagggtttgactcctttcatgataagtgcaatggactaaaaagaggctcaaatattatttatatatttaaggatgataaactttccatatgccatttaggccatttaggccatataccttgttcattgattttagaaaagcttaaaaatattgatattttacttatccctattggtggacatttcactctcgacggttttgagtctgcgaaactttgtaaccttatttccccaaaatacatagttcctatgcattataaaactaatacaacatctttatacttagacgaccctaagaattttataatatctatgaagagcgtaaaaaaaataaattctaatatattagatacttctgacttggatataaattctaaccttaagtctgaatgtatcttgttaacccctccatataaatagtgaaaatacctatttttaaataaaaaaaagaccgcctaaagacgatctctcttttattactcttggtttggagctcccactgggcaaacattagcacagtttccacaatcgatacaagtatctgcatcgataacgaattgagtatctccttgagttatagcactaactggacattctccagcgcatgctccacagctaacacatgaatcattaataacaaatgccatctagaacacctcctaataaattgtggtaattaacctcttacattttaacacgtattcgtatgtttttaaagtgttttgtattttagacttcttattttttaatattgttctattatttaagattacaaaacaacatatcctaaatcctctatagaatttataatcctttcgagttttaaaaagatatcattatatattactgttatctccctttttgcaagcgaaatttcagtagctattaccccagaattcttaacaactgtatcttgaattatcttggcatcgtcattagactccatattacaaatcttaataacagatttcatagaaattcctcctatttttcattaataagattttttattaatgttttatcttcttctgactcaacaatcaattttatattattttcatcaattgtatcttcatattttcctgaaacgagctctacatcagttattttgaattcctcaacaacttcctcgtctcctcttctaaccttaacctttaccatctctttaactattgaattaccaacaacttctccattcccagcctctatcttaacaatagaaccgaccttaggcagtctctttcttataccttcatatgtagtttgttcatagttcaaacagcacatcaatcttccacatattccagatatcttggttggattcaaagaaagattctgttcctttgccatttttattgatacagatgcaaagtctcctaagaatgtagagcagcacataggtctgccacatggtccaagtcctccaaccattttagcctcatctcttactcctatttgtcttaattctattctagttttaaatatagtagctaaatccttaactaattctctaaaatctactctgccatctgctgtaaagtagaatataaccttatgattatcaaatgtatattcaacatctattaatttcatatttaatttatgttcttgaattttcgctaaacatatatctaaggcttctttctctttatccttattttctttatgttttctaatatcatcctcatcagcgattctaataacattctttaaaggtgatactatatcttcctcttttatctccttaattcctataacgcattcaccaaattctatacctctagctgtctctactattacataattgcccttttttatatccaattctaatggactaaagtagtaaatctttcctgccttcttgaatcttacgcctataacttttatcattaattatacctccgcaaagcccataagcaaaacacttatgaccattgaatagttcgtattactattaaaatttattctagcttcttttatgtattctaacatactatttaatttcttataagatattcctcttgatatattttttatcttatatattttatcaaaattaacaacgagttcactatcattaagttctttaagaagtaagatatctcttatatatgatagaagtatatttagtaactctaatttatcttcttttgcactttttaataattcttcatactttaatataatacctttttgtctacttacgatatcttcaaataattctatacatatatctctcaaatttctcaacttatcatcgctaaaaaatctatctacatttccaggtattccagcactataagctaatgcagcttttttatcatcttcacttaaattattatatttttcctcaaggtaactcaaaatttcttctttatttaatggtgttaacctatatatttggcaacgcgattttattgtatctaaaattacttctaaagaatcacttagtaatattaaatgtacacctcttggtggttcttcaatagtttttaataatgcattttgagcttgaactgttagcttgtcacatttatataatattaatacctttttatcaccttcataaggctttttattgacttcacttataatgtttctcacatcatcaacaccaaatgaattggaattaggagaataccttacaatatcaacactctctacaccatttctctctttaataatctggtttgaaagatacttagctactatactttttcctattccatcattaccaattattagatttgcatgagaaaatgaatccttttgtcttctattatttatattatcgataatatttttatgtccgattatctttctcaatgcttatctctccttgatatcatatttttacgaacttatccacatcaattacgaatacagtagcacctcccacgctaatttgcactgggtattgttgcatatatccactttcacttcccccaagggtagttggtgtgactactgtctcatttcgctttctacatacattcctaataacatcaataacaagttcaactttttcctcttcaattcctaccaataatgtagtattaccagatttaagaaatcctcctgtagttgctaattttgtaactctataatcctcttctgttaaagcctctatgacatctgctgaatcttcatcctgaacaattgcaattatcaatttcattttaattcccacccttaaactaataataatttactacatattattttaccacaaataggtggctttttattacttactttatatttgtccatattttaggtcttagtatattttttatttgattaattacattttctttcgtattatttgcatctatcttaacaattctatgattattatttttataaacaatatcatatccttctctaactctttcatgaaactctaacttttctatatctaatctatttacttctctgcaatcattattagctattctagccaatcctattttaggatcaagatcaaatagcactgatatatccggcatatactcaccaatagcaaatttatttatacttaaaacttcttctattcctaaatttctcgcataaccctgatacgccaaagaagaatctataaacctatcacaaagaactattacaccttgattcaatgctggtatcactttttctacaaggtgttgtcttctcgccgctgcatataatagtgcttctgttttagcatccatctccttgttatctttgcttaaaataacttgtcttatttgctctgatattttaattccgcctggctccctcgtctttatacattcaaaattattttctgtaatccaatcatatattgcgtcaatcgccgttgtttttccggttccctcgccaccttcaaaaactataaataaaccttttttcatcttaaagtacccctctgtatattagcgtttaaatgtaagaatttaatttctaagcatgttcgctaaataagattatcctaacattatccttataataatcataatctggatcctctacatttgtattaacaattttctcttcacatgctttacaaatcttttctccatttaatattataccatcgcaatcacttgctccacataaaaaacatgatttatttgtatcctccattagtaattcccccttaattttatgattcctataaaattattaccaattatgtagactttatacaccttgtggatgttaataacttctatatagatatttttttaatttatggtaatactaataaagagcaatatatatttacacaattactactgaatttaatacaaattacataatgtaaatatagcttgcaaaaatagcttatattattaaattttcaaacaataatttgctcataatatttaaaatgatagctatattaagcttatatttaatacagctattatcatgttaacaataaaaacattaatatgaaaggagaacttactgtaaaacaaagcaaaacctgtactatatacaagatctagtaatttattttgcaagttttaagtaaggaattgcgcttatgaaaaacaaaattatttcatttttatctacttgtgctgacgatattaaaaatctctgtacctatttatatgagaatcccgaaaaaagttatagtgaagttaacgcgtctaattgcatatgcaatttattaaataaatacaaatttgaagttgatagaaattttttaaacattaacaattcatttatagcaaagaaaggccaaggtcatcctaaaatatgttatctatgtgaatatgatgctatcgaaaatgaaggtcatattaccgggcataatatgattactgcaatgtcagtatccgctacattagctttaggaagtgttatagatgacatcggaggttctgtaatactggtaggttgccccggtgaatactttggcgggactaaagggacaatggtaaaacaaggactatttgatgacatagatgttgtaatggtagcacaccctgacacatgtacatgtgaaagtggctcttcatcagcaattatcccattaggacttaagtttgaaagcgaaagcaagttgagttttttaaatcggaattcttatacatcattagatgccgttttactaactcttaatattttaaactctataaaaaaaggatttccagataatttagaaataaattcggttatatctaatggtgggtatacaacattgctattaccagcagattctgaaattaaattttgcattcgtgcatccaacacgaaaactgctaacgaagcttatgataaaataagaaaaattgcacataatgtgacagcattaatagatattcctaataaatttttcttatatgagtctcctaataaggagttaataaccaatagaacactaaataggctatttagtcataaccttaaagaaagtggaataataaatattaatccaccaaaggatatatatgctggattaagcattggagatgtaagtcataaggttccttgcatacatccatatatatctataatagatgatgaaaatattaaatatggaagcctagatttcgcaaaagcaactacatctgaatttgctttaaaacaatgcaatatagcagctacagctcttgcattaactgctattgacttgatacaaaacgaaactttactctctgaagttaagtctgaattctttaataatagaaattgctaataaaaaaattttaagatatggtatcttaaaaataatataatatatgcttttgataataataaactccatatattatatcgatttatattttaagataccatatttcacttcatagattctggcataataaaaaatcaaacgtaaaatactttgatgtattttcatattaaacttacagaataataaaaataatagtatattacaagaaatgctatgtgtttacaaaccatcttataatagtataatattagttgtactgcttaggaggtgttataaattgattcaaatctataaaagcgaaagtgaatttgatccttccctaaaattaatagatacgatagaaaatggtgcttggataaatcttattgctccatctgctgaggaactaatattaatatcaaagaaaacaggtgtccctttggaattcttaaaagcagctttagatgatgaagaaacctcacgtatcgatattgaagaggattcattattaataatagtggatataccgtttaccgaaatggaagataactctcttacttatgatacatacccattatcaataatacatactaataaacaattgataactgtatgcttaaaaaacagtaaaatcctaacggattttgctaataacaaaattaaatctttttatacatttaaaaaatcaagatttacattacaaatactaaatagaatatcaacatactatttactttatttgcgtcaaatagataaaaaaagtttaatgattgaaaaaaggcttcataaatctatgaaaaatagagagcttatacaattacattctctggaaaaatcacttgtttatttttcaacttcactaaaggctaatgaaattactttagagaaaatgctgaaattagagcttatgcaaaaatatgaagaagataaagatgttttagaagatgtaattatagaaaataaacaagctatagaaatgactgaaatctatagtaatatattagctagtacaatggatttttttgcttctgtcatatcaaataacttaaatattgttatgaaagtacttgcatcagttacaattcttatggcaataccgactataataggtggaatatttggtatgaatatagcattaccattatctgcagataatccacatgcattctctatagttatgggcgtaactgttggcatttgtggacttgttgcctttatattatataaaaaagatatgtttaactaacatatcttttttataatatcttataactactcttatcacctaagccttagttgtagcatcttgagtgcagatatccttttggagtttttctactcctttatatgatctaagttcagcttctatatcttcaagtgaacgattacgtgtttcaaataccttagactgaacaaaccaaattgctgcaaaacatattacaccataacctataaacaaactacctgtaccaaagtaattcaataatactggaaatgtcaatgataccatcatattagcactccaattaattacactactgaatgaattacctaagccgcgaatatttaatggaaatacttctcctaccatgacccacattacaggtccccaagtagctgaaaagaaagcaatgtaaatagttaatgcaataacacatatgattgaggcaacgaaagatccattagagaatttcattgaaatactcataatcaagagcgaaacgcccattccaatagcaccataaataagcatctttttacgatcaattttatccataatagctacagctatagcagtaattattatattaaaaactccaattccaatatgagcgagtaaagctgcttgcaccccaaatccaacatcagtaaatatagttggtgcataataaagaactgtgttacaacccataatctgctgaaaaacagccaaaccaaagcctatgactaatgccgggcgtacaaattcgctaaatagctctttaactccaccacttttaatctcggcttgtttttttatttgagctaattcataattaacagcacctttatcatgtttattcatatgttctagtatacttcttgcttcatctgctcgtccatcttttactaaaaatctaggactttctggtaacacaagtgcacctattaaaagaactgctgctggaatagctgcgaaccctaacatcactcgccaaccagtatataaatctgaaaatgcataattcgtaatataagccaatagaattccgctcataaccattagctgaaacaaacttgatatggttccacgtttttcagatggtgataattcagctaaataagttggaattagagctgaagatgcaccaactgcgacaccaagaatgattctaaatataattaatgaccaaatttctggagcaaatgctgatccaagtgcgccgacaaagaagataacagccgatgtaagaattagctttatacggccatatttatcagacataggaccaatgattgcagccccaagaatagctcctaataatacagaacttacaacccatccttgctgccatgaatcaaggtgcatttgttcttgaataaataaaatagctcctgaaataactccagtatcataaccaaacaaaagcccactaagtgcagcgaaaatatatattacagagttactaatttttattttcattaaaatcatctcccattttttatttcatttgatttaaattcgtatattcctagtgcgtttataatattcctaaaatttcttcgttcggaagactacttttatcgtttacaaaagatacattaattgcccagtatatttataatttgacttccatgaaatcttggtaaaaataactagaaatgctaacttgctcttacattctttaaataatgctgtactagtttttattcatatttatcatatagataaatataccttctattaataatctaataatgcatgcatgtatattagcttttagaaaaataggtacccaatatttattttccttaaatttagtatagcactctttgaaacctttttcaataaactttaaaaagtaatttaaaaagtaatttaaaaatttatttaatatatagttatgataatagtagacatttgcaattatagtaaatcaatttattcactgcaatccgattaaatataaaaacgtaatcactgcaaccatgtcatgttatatataattcattaattcactctattagtgactcattaacttataatatttctatgtaattaattcaattttaaattatagatttccataaagcttattatatacataaaaaatagcctatgtatcaactatttagttaatacataagctatcttaaataaattggaggcgccacccagatttgaactggggaataaaggttttgcagacctctgccttaccacttggctatagcgccattatggtggctcgaactggaatcgaaccagtgacacgaggattttcagtcctctgctctaccgactgagctatcgagccatcttacctcgcaacttcctactctcccacatagtctcccatgcagtaccatcagcgtaatagaccttaactttcctgttcggaatgggaaggagtgttacctctatgccatcattacgagattttcttttgaaagaaatactattctttcaaaattgcatataatttcaatgtatattacaacttgattatattggtcaagccctcgacctattagtatcagtcagctaaatatgttaccatacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctccacttgtaggtgtcgcagtcaggctcccttctgcctttacactcttcgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccaccaaggctgacgccctagtttcccagtctcccacctatcctgtacagacaataccgaaattcaatgctaagctacagtaaagctctacggggtctttccgtccaatcgcgggtagcgagcatcttcactcgcactacaacttcgccggatttgcagttgagacagtgcacaagtcattacgccattcgtgcgggtcagaacttacctgacaaggaatttcgctaccttaggaccgttatagttacggccgccgtttactggggcttaagttcacaccttcgcgttaccactaagtgttccccttaaccttccagcaccgggcaggcgtcagcccctatacatcagctttcgctttagcagagacctgtgtttttgttaaacagttgcttgtgcctattctctgcggcctgatttctcaggcaccccttctcccgaagttacggggtcaatttgcctagttccttaactgcaattcttccgtcggccttaggattctctcctcatctacctgtgtcggtttgcggtacgggcactacttctctctctagatgcttttcttggaagcatggaatcagatacttcggttccgtagaaccttccccattacgcctcagaattgttggaacggatttgccaatcccaactccctaaacgcttagactagcatccaatagctagcacatcctatccttctccgtcacaccatcgataataacgattatagtggtattggaatatcaaccaattgtccatcgactacgcctttcggcctcgccttaggtcccgactaaccctgagaagacaaactttactcaggaaaccttagatattcggcctgtaggattctcgcctacatctcgctactaatgccaacattctcactcgtaatcagtccaccgctccttacggtacgacttcagcccgattacgacgctcctctaccgctcacgttaaacgtgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccggactgatagtatgtggcattcggagtttgataaggttcggtaagcgctatgccccctagcctattcagtgctctacctccactactcacattttccgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctctgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgattatcatagttttcacttacgggactattacccactgtggtccaactttccagttgtgttcaattaactatgatttctcgttatgttctgtccgcaaccccagagataaatctctggtttgggctctttccttttcgctcgccgctactaagaaaatcgatttttctttctcttcctccaggtacttagatgtttcagttccctgggtataccttcataaagctatgtattcactttatgatacatggggtttcccatgtgagtttcctcattcggaaatcttcggatctctgactatgtgcgtctacccgaagcttatcgcagcttatcgcgtccttcatcggctcctgatgccaaggcattcaccatgcgccctttgtagcttgaccttttaagttttgttagtacaaaactggttatattaatcatttacaaagaatatatttcttggctttgttgtattttatatacattaaattatatgcaattttcaaagaacattggtgggcttaaatggactcgaaccatcgacctcacgcttatcaggcgtgcgctctaaccagctgagctataagccctcatggtggagattaagggattcgaacccttgacccctgcgtgcaaggcaggtgctctcccaactgagctaaacccccatgaggctttttgaaggaaaatccctcaaaattgaacagaataactactccaagtaacctttgagcaagtatttaaattttgatacattattatgcatctatactagtcagacatcatgctgatctagatttctccatagaaaggaggtgatccagccgcaggttctcctacggctaccttgttacgacttcaccccaatcgctgaccctaccttaggtcgctgccccgcttacgcgttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagactggttttaaagtttggctccacctcgcggtttagcatctctctgtaccagccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccccgaagggcttccccgattaagggtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaagtcgccttcgccactggtattcttcctaatctctacgcatttcaccgctacactaggaattctactttcctctcctgcactctagatatccagtttggaatgcagcacccaggttaagcccgagtatttcacatcccacttaaatatccacctacgctccctttacgcccagtaaatccggacaacgcttgccacctacgtattaccgcggctgctggcacgtagttagccgtggcttcctcctcaggtaccgtcattatcgtccctgaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcagattactcctttaattgctatgccatgcggcactacaatcttatgcggtattaatcttcctttcgaaaggctattcccctctatgaggcaggttacccacgtgttactcacccgtccgccgctaatccattcccgaaggaacttcatcgctcgacttgcatgtgttaagcacgccgccagcgttcgtcctgagccaggatcaaactctcaataaaaagtttaatcttagcttactcaaataaaaattgctggtttacttaaatgtatttatcatattctgttcaattttcaaagatctctcagtcaaacttgactgctttattatgataacatcattagctatcgttgtcaataattatttttaatattttttataatcatttaaaactttttagctaacttcttatctgttgttcatcaattactcgtgacaacgaatataatcatatcatgtttttcatacaatattacctgcatatccattgttataaataattataattcatatacctgcctttttctaataaatactcattattccaccatgtgacacacgtggaagtgttaattgtattgtttcaattattttctataaaaggcccgcaaaaacatataacaacgtctttactgttataggaatctactttaatattaataatatagaatagaatagaattaattacttaataattaattattcctatttatctataaatactattatatataattttagtttcaggagattttaattatgaatagaggaattttttatttcattttaccatttaccatgttttcttttataggatgctcaagcaacatcgcttcgccatccaactcacagacagctcccccttccaaaacatcaatacaagtacaaaatacccaagcaatggatgcaactgagcctaattcatttatcttaactagtagctcctcatacttttgtccgttcctttttaatggtaacaacttaatatttccaaatcccgatgagaataatagaatttcaattattccttctccttttcctaaagatattctcgaaagtaagagcgttactgattttgcaaattattctgctgataatatgaccttaattaatcaaatgatttatttttcaaatggttcagataataatgctttatcttcatttaacatttctgataaaacttacacaaagttgaatgacgattcagtaaataatttaatagcttctaattcagaattattctacataaataaaaataacgaaaataggatttacaaatataatacatcaacatcagaacactcattggtatgtcctgatagtgtaggctcttttataattaatggagattttattgtgtatcaaaacttaagtgataactcaaaattatattcaataaaaacggatggtagtaatagacaaaaacttaccgattacacagctaatagctttatagtttttgatgggcagttactttttttcaattcttctgataacaataatctatactcactagacccatctacattaagctgcaagagaatttccataatgaatggatttcagttaaaaattatagataaatctatatattttattaacggcagtgactcaaataacttatactcactatcagtagacttaaaaaattcaaccgctacctctaaaccagagatatcagagggtataaatgaatattatttgactacctcaggtatattctatagcccaagtataaatgtgaataatatatacttcaaagatttttcttctaaaagttaatgcaaaataggagataagtatttataactaaacacttatctcctatttcttgcattatgcacttataaagacttcactatctctttaaacttattacctcttatcataaaattaggatacatgtcaaatgatgcacaagcaggtgatagagtgacaatatcgccttgattcgctatgctttcagcaagtcttactgcctcttccaaagactcaaccatatttatattaattttaattcctttttcattttctaaattatcaaaaacatctttgatcttgtgctttgtcgctcccataaggatcaattcttttatatatgggtacccctcatatgctaaaggttcaaaaggtatattcttatcataccctcctgcaataactattactttttcatcaaatgctctaagccccgctaaagttcttgtaggacttgaagcaatagaatcattataatatttaactccgtctatctctcttacaagttcacacctatgttcaacgccagcaaatgtttcagcaacttttttcattacctccacagagacatcgtcttttgttgctaaaaatgctgcaagataattttcaacattatgcatccccttaattacgatatcgtcttttttgcaaacttccttgtcttcaagatagagtatcccatttttatagtatgctccatctatcagttctctttttgaactgaactctttcacatttcctttcgcttcttttataaatccatgggtaatttcgttctccctattcactactaaaagtccatttgaattttgatatataaagatattctttttcgcatctatatactcttgcatacttttatgcatgtctaagtgatttggggataaatttgtacatactgcaacatctatttcttgagtcattgtcataagttgaaagctagataactctaatacaactttatcttcatcatgtatgttttctatttctgaaaataatggagttcctatatttcctccgacccatgttttatacccttgaccttctagtaacttagaaataattgttgttgttgttgtctttccatcgctaccggttattccatagacttttcctcttgtatacctaacgaactcttccatctcagaagtaacatatgctccttcttttctagcccttactaatgcttcactatcaatcctcattgatggtgttttaaatatcacatcaaacccttttaagttatctagatatttttctccaagctccagcttaactccctttttattaaatccatctgcaacatctccaagttcttctaaattctttttatcaaaagccgttacagcagcacctaaatctattaaaaaattgattaacggaatattacttactccaattccaacaactccaactttcttacccactataaattctttaaactcattaaaatccttcttcatgatttatcctccaaattcaaatctctatccatcgtatatattattgccaaaatttgttcttcgttattttaattataacacttgcaacaaaaaaataaactgacccaagaagaaattatcttgaatcagtttttatttaggtataatcctaaaattccaaacttgcttggatataattttctatttcacttattttaattctttcttgttccatagtatctctatttctaattgttactgactcatcctctaatgtatcgaaatctattgttatacaataaggagttccaatttcatcttgtcttctgtatctcttacctatacttcctgtttcatcgaaatcaagattgaatttcttacttaactccgcataaatatccaaagatttttctgatagctttttagaaagaggcaatattgctgctttaaacggagctaatgctgggtgtaaatgcattacagttctaacatctccaccttctaactcttcttcatcatatgcttcaattaaaaatgctaaagcaactctatctgcgcctaacgaaggctctataacatatggaacatatttctcattagttgtttgatctaaatagcttaaatcctggccagaatgttcttgatgtttagataaatcataatcagttctatctgctattccccaaagttctccccaaccaaatgggaataaatattctatatcagaagttgcattcgagtagaaagataactcttcttctccatgatctctcattcttaaattttctgccttaacattcaagtttagcaagaaattccaacaatagtccttccaatatttgtgccactctaaatcagttccaggcttacagaagaattctaattccatttgttcaaattctcttgttctgaaagtaaaattaccaggtgtaatttcatttctaaaagatttacctatttgagctataccaaatggtactttttttcttgatgttctttgcactgctttaaaattaacaaaaataccttgtgctgtttctggtcttaaatacatttctgatttagcatcttcagtaacaccctgaaatgttttgaacataagattaaactttcttatatctgtgtagttcatctttccacatttaggacaaactatgttatttctttcaatatattctttcaattgttcgttagtccatccatcagctgtagctacttctgctccattttctgtcatatgatcttcaactaatttatcagctctaaatcttgccttacattccttacaatccattaatggatctgagaaacctccaacatgccctgatgcaacccagacttctctattcattaagatagccgaatctaatccaacattatacggactttcttgaacaaattttttccaccatgctttttttacattatttttgaattctactcctaaaggaccgtaatcccacgaattagctagaccaccatatatatctgagcctggaaatacaaatcctctatttttacaaagagccacaatcttatccattgttttttctactgccattgttttatccctccaaatatatttttataaaataaaaaaggctttaagcacaaagggacgaaatataattccgcggttccacccttcttggcttaagcccatctttcttcatcgatttcctcacactcaaaagctccattcatttataaccaataatgatttccaccaaacatcatctctcttcaactgacttataaattacttttctttttcaacatgtgtatttaatttataaattaattttaacaaaatcattttatatgtcaagactgaatattttctaaaaaaatataaaaaaatggctccgcgaagaggactcgaacctccaacctatcggttaacagccgagtgctccaccattgagctatcgcggaacgtcattacttaatctattatatcagtttttttagattatgcaacccttttttgataaaatatcaaaattatatctctatactatcaaagttatcaaataacatctacattttagaattaatacatattatatattcctaattcatctttatagagccttaaaagaacaaaatctcaagcgattgtgggactgtagatttttacccatctgatttttcaaatgtatgtgaaaaaattcggcagcataatatattttttcattctctttacaaactgtgattctctgagtaagtatttccataacttatgccctcaagagttacaatgttcacaactttaaatttagtataaattcatatggaataaaaaaaaactataacaatgctttcaaaatgcatgctatagcttataatactattctaaaaaaaataaaaaaaatggctccgcgaagaggactcgaacctccaacctatcggttaacagccgagtgctccaccattgagctatcgcggaacgtcattacttaatctattatatcagcttttttaaattatgcaacccttttttagcaaaatatcaaatttatatctctatactatcaaaactatcaaatagcatctgcctttagaattatactccttatatattcctgatttatctttataaaatttagaaataaaaaaactatagcaacacttccaagatatatgccatagcccatactataatcctaaaaaaatataaaaaaaatggctccgcgaagaggactcgaacctccaacctatcggttaacagccgagtgctccaccattgagctatcgcggaacgtcattacttaatctattatatcagttttttctaattatgcaagccttttttatattttatttacttttgcagttttcagaaatacctatggcttttctttcttatcatccaaagagaataataattcctataaatatttatgcagctaataaaatatttctggacttattatagaattccagatttcaaattatgtttctatattttattttttactcaacaaaaaaaaggttcatatatgctttttatacatatagaacctttttatagaaataaatataatctatttactttaactgcatcaaattatttctgtggtctcattgttgggaataatataacatctctgattgaagctgaatcagttaagaacattataagtctatctattcccattcccattccacctgttggtggcatacctgtttcaagagcactcataaattgttcatctagcatatatgcctcgtcatctccaagttctctctctttagcttgttgttcgaatctttgtctttgaactataggatcgtttaattctgagtatgcattacaaagttctctaccaaatacaaagccttcaaatctttcagtaaattcaggatttcctctctttttctttgtaagaggtgaaatttcaactggataatccgtaacaaatgtaggttgaatcatatttgcttcaccaaactcttcatataaagcatttaaaacttcaccttttgttactgtatttaatggtttagcaaattctaagtgtttttcctttgctatagtttgagcttcatcgtcagattttatttcattgaaatctaccccagcatattcttttacagcatcaaccatagtgattcttctccatggtggcttaaagtctatttctgtaccttgataagcaaccttagtagttccatttactttttcacaaatatatgcaaccatattttctgtaatttccatcatgtcattataatcagaatatgcttcgtataattctatagctgtaaattcaggattatgtcttactgacataccttcatttctaaaatttcttcctatttcatataccttttcaaaaccagcaactattaatctcttaagatataactctgtagctattcttaaatacatatccatatctaaagtattgtgatgagtaatgaaaggttttgctgctgctccaccagctattgctccaagaattggagtttctacttctataaagcttttagcatctaggaattctcttatagctgaaatgattttacttcttttaataaaagtatccttaacttctgtatttgtaattatatcaacttctctttgtctatatcttaaatctggatcttttaacccatgccatttttctggaagtggctttaaagatttacaagtcaactcaaaagtatttacatttactgatacttcacctgttttagttgtaaatacttctccagttgctgcaatccaatcacctaaatcaaaagttttatattgctttaaattttcttccccaaccttatcaatctttaagaatagttgtatcttaccatccttatcatgtatatctgagaaaacaacttttccctgccctcttttagacattagtcttcctgcaacggttacttccttaccttctagtgcatcataatttgccttaacttcctctgatgtatgagttctgttgactttataaacatcaaaaggatcctttccagcaccttgtagctctgctagtttagctcttctcaatccttcctgttcattatactgagactctaactcttgcatgctcatttcttctgttgacattgctgtacctccaattaacttctacttattcctagtatttcgaatttattaactccgtctggaactgttacctctactacatcaccaacttttttaccaactagtgcatttccaaccggtgattcgtttgatattttaaaattcataggatccgcttctgccgaacctactattgaatactctacttcttcatcaaattcataatctttaacttttacctttgatccaactgaaacaatatcacttggaatctctgattcatctacaaccactgcatttttaagcatattttctaattgaattattcttccttctgtaaatgcttggtcgtttttagcttcatcatactcagaattttcacttaaatctccgtatcctaaagcaatttttatcttttcagttatttcttttctttttactgtttttagatattctaattcactttctaattttttaacaccttcataagtcataacatattgttttgattggctcatatactttaactcccctttaaaaccttctatattatttattttagttattgattataatctttattttgataaattatctattaaataaatctttttaagcaatctcctattatatcgttaacagagagtacctataaatttataataatttaaaaaatattttaatctgaaaatcatttaacttattataaatcagcatatttcatatgtcaataaatcctaatttgaagcaattcgctccattagttagcaactacttcggaacaactttactcatagcaatgattgctatgaatcaaacattaaataaacctagtttaaatattaatataaaagtaaattagtaaaacataaattataatttttacgcaaaaattaatactcatatttatactagatttattatgaaaccaaattgcatttttctaaatattaataatatgcttgaaacaattaaataattctagttatacttacaaaactataattcatcttgatactttcttaaagcttcaataactttttcactatcatttatagtattaatcttatttttaagttctgtgcatcttggaagccctttaatataccatgatgcgtgttttctcatttctcttatcgctttaaattccccatcatattttattgctaattcgtaatgcctaatgcacatttcaattttttcattatctgaaacttcttgaattacttctccattaagcaaattatttatctgtctaaatatccatggattcccttgacttcctcttgcaatcattattccatcacaatttgtagttcttttcattctgatagcatcttctggagaaaatacatctccatttcctattacaggaattgaaacactgtccttaactctctttattatgtcccaatctgctttcccttgatacatttgttttcgtgttcgtccatgaacagcaatagcatctgctccagcttgttccatcccttttgcaaattctactgcattaatattatcttcatcaaatccttttctaaacttgacagtaacaggtttggttgaaactttttttatagttctaacgatatcgtatgcaagttccggttctttcattaatgcagatccctctccatttttaactattttgggagctgggcatcccatattaatatcaattatacaaatatctttcctgttatttaaatattcctcacaaattctagccatcacatctggctctctaccaaatatctgggccgcaactggtttttcttcatctgctattctaagtaaggtttgtgtattctcgcttccataatataatgccttagcactaaccatttcggtgtaaaccaaaccgcatcccatttccttacataatcctctaaatgatatgtcagttactcctgccataggtgctagaaatatattgttttcaaaggttaaattccctatcttcattgtagaatatactccttacatcttgtataaatctcaatttccatataatttatctttgagaaatctctatttctttatttttttcatataatatttttaatccttctagtgttaaatccgaatcaaccttatcaataacatcagtctctttagctattaaatttgctaatccacctgttgctaatacaaaaggttcttccttatacttagaatttttcatttcttgtttcatttttttcactatatattcaacttgcccaatataaccaaatataataccagattgcatacttgatacagtatttttgcaaatcatattttttggtacttctaattctactctaggaagcttagctgctctttcaaataaagcatctgccgaaattctaattccaggacatatgcatcctccaagataatctccatttgctcttactgcacaaaaagttgtagctgttccaaagtctattattataactggtctcttgtaaatttcatatgcagcaacagcatttactattctatctgctccaacttctcttgggttatcatatttaatatttattccagttttcactcctggtccaactattataggttcgtgacaaaaacattttcttaacatattttctaaagaatgcattatattaggaacaacagaagaaactataactccagtaatatttttaggatcaatgtcacttaagttaaatagttgcataacttgtataccatactcatctgaagttttatttccttcacttgaaatacgccaactagctatatacctttctccattatgtactcccaaaacaatgttagtattacctgcatcaacaagtaaaatcatagaaagcaccaccttaatatagttaaattaaaagcagcccgaagagctgccttaattttgaaattgactaaaaaataacaatataattttaacaattatatttaatttgtcaagagtttaaatgtgattttagattaataccaccattttctagcttctgttttcaccttaaatacacatatatgcattcattagaataatcctattatttctccactttttaatacatccatcttatttgctgccggtacctttggaaggccaggcatagtcattatgtcacctgtctgaaccactataaatccagctccatttgatactctcacttctttaactgtaatatcaaatcctgtaggtctagctaaaaggctaggattatctgatagtgaatattgcgtttttgccatacatataggaagtttatccaacttaaacttttctaattcgtcaatttgtttttttgctgctggagtataattaactttatctgctccataaatttcactagcaattgtaaatattttctctctaatagatttttccttatcatatataggctcaaaatttgattcactattctctagtgcatctaacactatattggcaaggtcaattccaccttcaccacctttagcccacacatcacacaatgctactttaaccccaattctatcgcaaaaatctttaatgaattccacttcttccgagctatctgtaacaaatttatttattgcaacaacaggtgtgattttaaacttctttatattctctatctgtttttccaaattagcaattccatcttttagtgcttcaacatttgggatatttaattcagtcttagctactccgccatgatgctttaatgctcttatagtcgcaacaactacaacacattcaggttctaaattaccatatctacatttaatatcaaagaacttctctgcacctaaatctgctccaaatccagcttctgttatgacaacatctcccaactttaaagcaagcttagttgccattatagaattacatccatgagcaatattagcaaatggtcctccatgtattaatgcaggagtattttctaatgtttgaaccaagttaggcttaatcgcgtctttcattagtagcgccatagctccttgtatttctaattccttagcataaacaggatttccatctaaattatatgcaattactatattacccattctttctttcaaatcttctagatcacttgctaaacataatatagccattatttcagatgcaacagttatattgaacccatcttctctaacaaatccattaacctttccacccatcccaacaatgatatgtcttaacgctctatcattcatatccattactcttttaaatacaattcttctagaatcaattcttaaaacattaccttggtgaatatgattatctattgctgctgataacaaattattagcagatgtaatagcatgcatatctccagtaaaatgaagattaatatcttccataggaacaacttgagcatatcctcccccagctgctccacccttaatcccgaaaaccggtcctaatgatggctcccttaatgctataacggctttcttcccaatcctgtttaaagcctgaccaagccctactgtaactgttgactttccttctcctgcaggagttggatttatagctgttaccaaaactaactttccattattattatttttaaccttatcatatacatctaaagatattttacacttatattttccatagtactctatatcatcttcgcaaagtcccaatttttcagccacattttttatcggctccatctttgcctcttgagcaatttgaatatcacttttcatttaaaatccctcctaaatataaacccaaaatcatacttaatataatttattatatcatttcactatacataataaaagttttttcgaataataagtataaatggactccgaatattcgtattaatataaatattctatgattctacatataaaaaattaaagggctatttcaaacccattttgtgcctgaaatagcctgtgtattaattatttacaaaaatatcttcaaattcttctgcatcaagtttttctttttcaattaaagcttttgcaacagcatgtaatttgtttatattttcttttagaagcctattagctctatcataagcctcatctataaatttctttatttctttatctattttagaacctatctcttcgctaaagtttctccccttacctaagtctcttccaaggaaaacttcatcatgccctgaagtactaaatgatatagttccaatttcttcgctcataccataatccataaccatacttctagctatatgacttgctctatctatatcattttttgcaccagtacttatatctcccataatcaatctttcagcaactcttccacctaggagtccaaccatctcatcttttaatttagacttagatgtataagaagtatcctcctttggaagatgcatagtatatccaccagctctacctcttggaattacacttatttcgtgaaccggatcacagtgtggaagcaatctcataacaaccgcatgacctgcttcatgataagccgttaatttcctatcatgttcagttattaccctactctttttctcaggacctgcaattacttttgttattgcttcttccatttcagacatagaaatttgttttttgtcttttctaacagcaagtaatgccgcttcatttgttaagttttctaaatctgctcccgaaaaccctggagttcttctagcaaggacatctaacttcacatcatcatttagtggtttctttcttgtatgaactttaagaatttcctccctaccttttacatctggagctccaacaattatttgcctatcaaatcttcctggtcttaataacgctggatctaatatatcaggcctatttgttgcagctatcattatgataccttcattagcaccgaatccatccatttcgacaagaagttgatttaatgtctgttctctttcgtcatgtcctccacctaagcctgcacctctctgtcttccaactgcatcaatttcatctatgaatactatacaaggtgaatttttctttgcttcttcaaataagcttctaactctcgatgcaccaacaccaacaaacatttcaacaaaatctgatcctgatatactaaagaatggcacgcctgcctctcccgctatcgcttttgcaagtaatgtttttccagtcccaggaggcccaactaataaaacccctttaggaattcttgcgcctatctgtatatactttgatggcaattttaaaaattcaacaatttcttcaagctcagctttctcttcatccgcacccgctatatcttcaaatgtaactgtttgtgtatctggagttaccattttagctttgcttttaccaaaattcataacccctcttccaccacttccgctttgggattgttgagtaaatataaataggaatataaatataaatactgccattaatataaatggaagtaatgttgctatccatgttgcattattagatggtttctcaaaaacgactttaacatctaatttaggctgatttactataagcgaactaacaagttcacccggagcaatagtaacaaaacttttattatcagtagtttttccttctatagtcatgctgtcttccttgactaagatactttctatttcatttgaattccacttttgtataaatgaactataagttatctcattagaaccttttcctgtttgccacatagtaactgctgctaaaatcagcataactgagcatacaatccatacagccgcacttgaatattttttcattcaaggcccccctctctcatcatatttaaaattttaccataggaatatttttattacaattaaatttgaactttctatttttcatatacttcaggctttaatatccctataaaaggtaaattcctgtatttttcagcataatctattccataacctactatgaatccatcaggaacctcaaatccaatatatttaacatctaaatcagatttacgcctcgcttgcttatttagtaatgcaactatttctatactatttgcttttctcgcttttaaatatttaagcaaatatgttaatgttactcctgtatcaacgatatcctcaaccactaaaatatcttttccttctatactattatctaagtcttttaatattcttacgacaccagatgtttctgtagaacttccatagcttgaaactgccataaaatctatttcacatttaatagatatgttttttattagctcggcagcaaatattactgatccttttaaaataccaactataagtaaatcttttcctctataatctgtacttatttcacttgcaagttctttaattctcttacttaaaatttcttctgagtatagtatctcttgtatatcttgtttcatatttaatattcctttctttgaacgactacttttaatatattcgtacttttacttgtaagtttatattcttctgagattctaattccaataacccatgcaatcctttcatcaaagcataaaatagggatgcattctctttcattcttaggaatcttcatatcaataaaaatatcttttaattttttgctaccactcattcctagtggaataattttatctccattctttctatttcgtattgaaatattattattaattttatcaaaatcaaaatacttaacgaaatctccttgctttaagtttatagaattttcattataaccattaattatagaaaattgaataacatacttatgaaactcaactgtatttatatatatgttatctttacctaaaattatttcttcttttttactatttatatctgatttttttgtctttgtttttatgtatatatctccataaacattttcagcacaaactccatttggaagatgcactaactttccagagtatttttgagccaaacaagatatttcatatatatgcttaacttcaaaatcgtaattagactttgaataccttgttaacgcatgccttaatactctattaaccaaaggttcttcctctttaaatatttccttttttattataaaataatcattacattccatacaatatttattgtataaaccagcggataatttttcaaggaattcattatctttttgcaataatgtagacatcctattcaaagtctgtactatatcttcattaaaattttctttcatatatggcaatatatctaatcttattttatttctattataaattttttcaaagttagttttatcgattcttggatttaagttctttagttttacgtagttttctacttcttctctactcaagcataaaataggtcttattattttatcatctctagaagccctaattcctcccaacccttcaaggcctgttcctctcataagcctaaataacactgtctccgcctgatcatttgcattatgcgcagtagcaatcttattaaagccttctttttctaagatttcatcaaaaaaatcatatctagcattcctcccagccatttccgaagacaacttactttccttagaataagcattaatatctacacgtttgacaaaacattttattcccatatcattgcatgtattaatgacatatctctcatcttcaaatgcatcttcgcctcttaaaagatgatttaagtgtgcagcagctatacttatatttaatttttctcttagctcaaataaaacattcaaaagacatatagaatctggtcctccagaaagagcaatcaaaattttatcattgggtttaataaggttattgtcttttatataagacagtacttttctatacaaaaataacactcctacttatttattattatgtcatatacaattccgcttcttatattttacgtatatatgttctaaatgtaaacattattgcttcaatttaacagttcaaaactcattctatataaatataacattattcttaaaaacaatcttatttatttacttaaatatgaaacaaatataaatagctgtttcaaatttaacttacgatttaaatttttgaaacagctatttataatattttaataacttattgcatgataatcttagctatctaaataaacttttgaaactactactgtcatatcatctttaattgttccattacttaattttttcgctctttctagcaccttttctgacagttctctaggatctgaattaattgtctttaaatagtcttcaatccaagttgattctccagagtttgatttatctatatctaaaataccatcgctaacattaattaaaatatcaccaggtcgtagcacttctcttataacttccacgtccacttcatctacaagtccaaaaggtaaattcttagaattaatagatattacatcacggcctctttttataaagctaggtgctgcgcctatctttacaaatattgcattaccattatataagtcaattctatttaaatctaaagttgcatatttttcatcttccgaaaatctcattcccattatagaattaactgtgttgaccgttatatcttcatcgaaccctgcttcaataagcttttctaccaaatcaacagttgctttgctttcttccttagcctctggtccagaccccatcccatcacttagaattgtcatatacgttccatttcttgtccttccaaaactataactatcacctatttgagtttctccaccttttggttccattgcaccataagacaccatataatactttggtttttcttctatcgttataatacattcatttgtctgtggatttattttacaaccatcatccccaatacataatttcattctcatagcactgctcaatagagaaactatgttttttccataataatcagctccttcgcaattatttacacttaatctaatcttaaccctaccgcttttatctatatagcaaaaaatatcattgtaatatatggagtttttattcagtatacgtttcgtcaatctttctaaatcagtatctattctaacctcctttttaaaatcattaagaagattatctaaagcacacgatatgttagttatatgggatgataatatatttcttccttctgctaacctttcctttattgattcatttacattataattagttacaatcccttctgcattttttaaaagtgtaaaattcttaatacatcttttttgcaaatccataggaattgctaatttgccctcctctttactttgaattaacatttgaaaagagttaaatgtttgatgaaactctctttcccaacataaaggtctattttcgcagcttgaacaacttctatctgccaagttttctaccaatgcactccctttcgatttaatcaataaattttcattatcattgttagttaataagcatcttgatacatttgtaagtacacttgtaagttcttttaatttaaaagtaaattcctcctttattgcattcaattgaatttcgcctaaagatgctttctttctatatggatttatctcaatttcaatacttgtaaatacaggttttggaacacacaaaaataaaacagaactagtaagaacctcaactcccaacttcaatgttactgcattagagtacaaagctaatgcagtataaattattatacctgatagtattgaaaatattttccccgtatctttaaatataccaacaattaagcctccaactccaaaaaaggctacactatacatcatgtcatttgaagcaactccaagcattatacccatagaaactccaatcatagttccatatgttgcgccacctacatacgcaattgtcaaaactaatgtaagtgcgcatatatttcttatagagtaattactaatatttatattacctattcctgcaactaataaacacaaaaatattccaacacttactatttcctccgaagaaaagaagtaattagtattaatctcttccaaagaatttaacgcatactttataacataatatatgggcaatacaattaatgtctgtattaaacataaagttatatttacgccaagttcatatttattaactagtagaccataacaaaaaaaactacttagaattattacaaaacccactaattctttttttctatttttagctgatgctataaacacatagtaaattgtaactaaagctacagatactaaatatacataaccgtctgtcagtaaactacttattgttagatatcctatagcgattcctatcgccacagttaaactatttctcctattctcttttgtaactacagctatcaaatacgcaattcctattggcgctataccaagactatctgattgatttaataataaatttactctaccgagcaagattcctgacattagaataatccctaacttcactatagatgttttcatccataacttttttcttaagttttctactctagttattccttcatacttatccaaccctaatccatactgcacattagctcgcctcatttccaaataatgtaacttgattatagcatcataaccttacgataaatgtcataaggtgtttatcgtataaagttttcgtaggacaacttcatctatatttctctaatatctaatgatttaatagattattttctttattacattttgatctaatatcatacttagtcaaggtaaatcaagatatctggctaattattaaaattagaacgttataattaatttgtcgttaatcttattttattagaaatttatatataaaatatttttcataaaattataaatcgtgaatacactttttaattactccttaaaataatattttttacgattattctccgattttcttggcttaagtgaccaaaattcgtattcagtaatcaatcttatgacaagttaacttacagtactcaaaatattaagtactaaaaaaagcctaacataagtgtagtcatctacattcatattaaacttctatctataactaatttaaacaccatgttagaaaagtaaactttaaatatctcattcttagaattataaatcgatgctaaagttttcttctcaatggctaggaatttattcagaatattatacctttatcttatacttcatataataaatattttccaaacaaaaaaagacctgagctattgcttaagtcttatggttgcggaggcaggacttgaacctacgaccttcgggttatgagcccgacgagctaccaactgctccaccccgcgatattattcttttcatatatatggtgccgaagaccggaatcgaaccggtacggtgtttaaccaccgcaggattttaagtcctgtgcgtctgccagttccgccacttcggcatattcattgtatcatacaagcttacgacatataaattaaagctttgataacaaaacttactaaactttatggttgcggaggcaggacttgaacctacgaccttcgggttatgagcccgacgagctaccaactgctccaccccgcgacattattcttttcatatatatggtgccgaagaccggaatcgaaccggtacggtgtttaaccaccgcaggattttaagtcctgtgcgtctgccagttccgccacttcggcacatattggtagcggaaataggacttgaacctacgacacctcgggtatgaaccgagtgctctagccagctgagctattccgccatatcaatggttgcgggggcaggacttgaacctacgaccttcgggttatgagcccgacgagctaccaactgctccaccccgcgacattattcttttcatatatatggtgccgaagaccggaatcgaaccggtacggtgtttaaccaccgcaggattttaagtcctgtgcgtctgccagttccgccacttcggcacatattggtagcggaaataggacttgaacctacgacacctcgggtatgaaccgagtgctctagccagctgagctattccgccatatcaatggttgcgggggcaggacttgaacctacgaccttcgggttatgagcccgacgagctaccaactgctccaccccgcgatattatttttttcatatacatggtgccgaagaccggaatcgaaccggtacggtgtttaaccaccgcaggattttaagtcctgtgcgtctgccagttccgccacttcggcatatcttataaactaagtgccaacgacaaagctaattataatacatattctttttagtgtcaacaatatttttttattaatcttatatatttaaaattttaattgcaataatcagtaaatcacaagttttaagcactataaatatccatttataatcttaataatgcagaataaactgtaaacaaatataaaaatttctctacaaatctattctacatttgaaatttatcaagcaaattttatatttattttcctaataaagatttcaaaaatttttaacagcctttttttccacctttacttttaaattcttgatgtttctttacatcttgcattctttcttcgctatcttttagaaacttagacataatatcttcgaaatttcctgaattagtagttttcttcttatcaggtgccttccaatcaatctctgctggtttaaccgattttctttgaacatttgcttgctttattgaaagactgattttaccattatcatcaattgagataactttcactttcactttatcttgctcactaagatgttctctaatatcttttacgtaagaatctgccacttctgaaatatgaactaatccagttttgccttcaacttcaataaaagctccaaagtttgtgatgtttatcactgtgccctctactatgtttcctgccattaaggtcatgtttaaaagactcctccttaaatttaaaaatatataaatttataagaacaaatctgctgtgcagatgctctttaatttagaatacaaatttaattatttagctactataatattaccagagttttataagtttttctataaattgaaatttaattttgatttgttatctcaccattaacaactttttcaccaggcttaatcatcccaagtctttcccttgctaatttttcaagataatccgatgagtttgaattaattttatcaacttcatcttgaagtctttcgtttttttgcttaatttcatttaactgaacttgtttactgtcaatttccttttgaattctattcattgtcatactttgcctaatgtaactaaaggcaaagaaaataataaatccagtaattattgtccgctttaatattaacttcgttttcatctataagaacctctattttgcaaattctcttaagtctattgtaaacactatattagtattattcaagtaattttttatcatttccttttatctgtaattttatatgcaattatttttaatggatataataaatttttcaataaaattctaatcaacttataagataattttgcaattagcatctcgctgttataaaaatacttactaataaatttaaagtataatataatggccataattatgaaaatatatacatagggagttaaaaatgcataattagtatataataaaaaggtaaaaacaatcaaagcaataagtacacaaaatagcatatcttctattattgttaatatctttatagagtttaatcctcttattcctctatatatatcaaacaatattcccgttataacacctccaattaagctgcatataacaagattaatctgcatattcaatcctaaaggcatactatattcctacttaaacaatctgcttattatgctttcattgcttttcttagatatctttccgttatataccatagatgcaatgcttccagcaattataacatcaccattttgcacatccaacttgttcatttttaactcttctcccttgatagttaaatttcctagattagttgttaaatctattttttgctcatcaaaacttataacctctataacaccacttaaagttaatttttttctattctctagagataaacttgatttattatcttctactttattttccactcttttctccattaaaaattcctccatttatttttcttatacaatatatgtttgtattttgcattttagaatttagaacctttaataagttaagtatagtggaatttatttcttaaaagctgttaagtgttattatttatgataatttcacttaacataaatcttttttgttcaatactcatatatagataaagagtagataaactatatagtttctactctttatcttcttcaccctcaaggataatatacatttcttttgcttcttcttttctcacatgttctactacactagcaatttccgcttttaatactttattagcaaacgttatttcaattatatccccttcttttatttttgtagaaggctttgctactttcccgtttattaatatacggccactctcacatatttctttcgctacagttcttctttttataatacgcgatacctttaaatatttatctagcctcacaatttctcctccattcaaaagaacccgagaaaactcgggttcatatttactctgtctaacttgtattttattacttgttaactttatctttgaattccttacctgctttaaatactggaactgttgttgcaggaatgtttataacttctttagttctaggatttcttccttctctagctgctctttctctagtttcaaaagttccaaatccaactagttgaaccttttctcctttttctagtgcttcctcaacactttcaattaaagcttttaatgctaattctgcatctttttttgttaatttacttttttccgccatactagtaattaattctgctttattcacaataacatcctccttaaaatccagttacatattttctaactgttttctttatgtactaaattgcacttctttattatataacctcttcagctacccgtctatagaaaaacgctttcttttcctatatataactaaataatccaataaatcgttacaaagtagttctttataaaattattattcttcataaactagaaaattcctttatttaaattacctattaacctaagttttttgaaatttcccatagttcattcatttcatctaaagtcatacttgttaattcaatattcttatccttggctgctctttcaatatactgaaatctttttataaacttgtctatagtataatttaatgctatttcttcgtctactttcagaaaccttgcaatatttacacatgaaaatattaaatctccgacttcttcttctattttctccacattttctgtattatatacatcaattacttcttttaactcttcttttaccttacttacagcaaaatctatattttcaaagtcaaatccgaccttacttgccttttcttgaatcttatgtgctcttaaaagtgcaggtagtccctttgttattcctttcagttcatctacaacactattatatcccttttctttcttctttaactcatcccactttattagtacatcttctgaagaattcaatccatcggcatctttaaatacatgaggatgcctacttatcattttattgcaaattccttctatcacatctcctatatcgaaatatccgtcttcttttccaatagatgcatgaaaaacaacttgaagaagtacatctcctaattcttcgattaacgaattatcatcatcttgatctattgcgtctattacctcatagctttcttctattaaagccttcttaagagacttatgagtttgttctctatcccacggacatccatcttcacctctcaaaacttctattatatctaaaaagtcattaaagtcttttttgttttttaaatcctttggtatataaatagatgttaaataatctatgtcctcctgcatatccagttcaaataacggtatctttcttatgctttcctgaccttctattccggctgctcttacataataaatctctgtttcatcattatagcattctagcaatcttaatttaacttctgatgctatcaattgattgtatacctgagtaataattgttcctattcttttgtctaaaatttggttacttatgtcaaaagagtctataacctttaacccctctataggatcaatcttaaggctttcaatcattgcatcgataaaacttactgctggtataactttatattctattccattttctttacatagttctattaagttaaatactgatttttctgcaaccaatggatgacctggaactgcataaattaaatcagtcatattcttatgtttattaattatgtcttttgcgatatttaagtatacttcatcaaaattatctatgctatcataaatattatcataagtatcaaatacaatatttttttccttcaggtaatctactgttggatgcttttctgttcttagaaatatatgcttgcttgcttcgagttcatttattgttcctattgtcaatgcatccttacttcctggtcctaatcccactatcttaatcattagaatttctctcctttttactttcttttaaatctatctcttatttcttcaacattaaataccttgaatacaattatcattataatatatactatcatacccaaaaatatagatgtcaagcaagatattccattactaattgtattcttatataaaatattataacttattaatacaattaacatcataatactggatgcatagcaaggttttattaatatttcgtataaattaagtcttactcttagtgtaaatttcatcatcactatatttaaaatacttactgttaaataagctccaaagctcgccaaaacagcaccatatatgttaaacatttgcataggaactaatacccacgttaatacaattttaatcaaacacccaatcaagaggttaataacaggttttatataatgccctgttccttgtagtattgctgttgttgtttgagtaattattataaaaggaattgttaatgataaatattttaatatctctattccttcaaacctgcctggaaatataaacttcattactggttcagctaaaaagaataacccaaaagtgcacggaatagcaattactgatgccattttcatagatgcatctattttactttttagctctttctgtttcttaagtatgaaattctcagctatgataggaattagagatgtacaaatagccatagaaagagttaatggaatatttacaattacagacgctttacctgttaattgcgcatataatacagttgattgtacatttgtgaatcccgcatctaatagtttttgtggtactaaaatggaatctattaaattcataatacttgatactgtagtacctaatgatattggtattgcaatctttaatatagtatttaatatttctggattgctttttatttttttaatggcataacgtttctttactcttttataattcgagtataaataagctcctccaagaacagctcccgcagttgctccaaatgctgcaccacctgctgagtactctatgcctctaggtagtaaaaatacagcaagtccaacaccgaatatgactctaccaatctgctctattatctgtgatatagctgacggagtcatattttgtaacccttgaaagaatcctctaaatatagttacaaatgatattacaattggtgcaaatgatattccgattaatgaataatacgcttttggatcccacttcaaaaataatactattggttttgcaaaaaagaataatgctaaagttgtgcctgtccctattattgtcattaaaatagcagattctttcattacttcaaagcttccatatatatcatttgttgcattcttttctgatatcatcttagaaattgcaactggaactccagaagccatagctataaaaaacatatatagcgggtatgacatttgataatatccaattccctcatctccaattaacattattagtggccatctaaagaatagacctaaaaatcttgttaatattcctgcaactccaagaattatgctccctcttattagggattgttttttcataaaacacctccaaccttacatgttactaattaattattattgtaagtttggaggtattattccttttattttcataatgtggttatttataagtattattgctccatttgtttacctaagaatgctgctgctgtctcaactagctttgtttcaacttcaccaagctctccatcttcttttgaaagaataattacagctcctatttcatcaccctcagctatgattggtgatataacttgactagtatactctgtttcatcgtcatcattatgtaatggtattactgcgttatcagctttatttaataatacagtttttcttccgtccattatcttttctagctcactgcttacttttctttctatgtagtctttttttggtgcaccacttactgaaacaaatgcatctttatcagctattagtactacatgacctataacttgttgcaagctttcacaatattcctttgaaaagttagtaagttcttcaatcggtgaatatttttttaaaattactccaccatctctatcggtaaaaatttctaaaggatccccttctcttattcttaaagttctccttatttcctttggtattactactcttcctaaatcatcaattcttctaacaattcctgttgccttcattggttatataacctcctttgaactctattaattggttgcactattattatttgaatttctagaaattttatacacttatagacaaattttatattaattatttttttgttaatataaatgctgttatttcaatgtaatacatatagtagaaacaaaaataggactactttgaataatcagagatatttcaaagtagtcctaactttcattattaacagctaaattattaatagctacctaattatattttagtattataatttatcttcataagtttttacttttaggtctgttttccattctgtaatcttagaacttaaagcatcttgttgcttttgttgtaataatgatgattttatttgatctttaacttgttcaaaaggagttacttgtgagtcttttaatccagtagccttaattatatgatatccgaactgactctttactggcgctgaaatttccccttctttcaaattcttaaacccatccataaattcagcaactaattgtgttgagttatatgctacaaatcctaaactaccaccattatctttagttcctgaatctgttgagttttccttagctaatttcgcaaaatcagctccagaatctaattttgcttttatatcgttagcttttgttaatgatgcatcataatctattgatccatcactagccttttcagctattagaatatgtgatgcattcgctccagctccttgtgtatattttgaatccttattttcattataatatgtttgaacatcgtcatcagtaacttctatatctttcactatatcttgttgaacagcctgcattataacattattttttacaacatcttttagctgatcttcagtcaatccattttgctctagaacactttcaaattgtccttcttctgaatattgggatttaatttgagctatctgatcatcaacttgcttatttatatcatcatcagatggcttaagatttaactcagtagccttttgtaatactactttttgagttactaagctatctaattcctgtttttttgcttgttgtaactgatctttaacttgagcattactttcataattatctccatactgctgttttagttgtgcagtatacttttccatttctttatctaaatcaccttttgttattttttcatttccaactgttgcaagaactgttttctgtatcgcttctggtgttttctcaatcattttgcaacccatagctgataccgcaattgtcaccatagctaaagctgcaacaaatttttttaattttttcaaagttttcccctcgcttattctagatttaaacccactaaaaataactttccacataaatatatataatttagacaagctaaaatcacttttcaaattctacttaaacaaaactttctagaatcataaaacgaaatttgaaaagctaaattaatttttgtcggacgatattattcttttaggtttcttactgtaaaaattcataacattagtatatcaatattgcttttataattcaaattttttacactattttatttcttctacttttcttttatatcatagatttgttacaatattatgtcatcgaaaacttccttcagaaactccaatttattttccttcttaatatattttaatttaaatgcgaaataagggtttgaaccaaactttaatactacgctattcttatatttttccatcaatattttaaatatatttttatattcactttcaccttgtgaaaacttgaacaataattcttttggagtttcttttatctcttcaatgaatatagatttagctctactctttatataagcaatatccattaaattatacacaggttctggtatcttagagtatctatcttctagttcttctttgatatcactataatcgtctaatccctcaattgcagcaattttcttataaacttcaattttttgaatttcatcttctatataattttctgatataaaggcatctacttttatatctaaggttgtttctataggttctttttgaatttcacctttaagaagtttaacagtatcttcaagcattctgcaatacagatcatatcctatagaggccatatgtccatgttgagaagatcccatcatattacctgcacctctaatttccaaatctctcatagctattttaaaaccagagcccaattcagtgaaatcctttaatgctttaagccttttttcagcaacttctgttaatactttatccttagtatatagcaaatacgcatatgcaattctatttgatcttccaactctacctctaagctgatataactgagaaagtcccatcttatctgcatcatatattattatagtatttacattttgaatatccattccagtttctattatagtagtgcagactaatacgttatactcttctgacataaagtcaaacatttccttctcaagttgtctttctgccatttgaccatgagcaattccgaccttactctctggaactaacgattgaacatacttagccatcctttcgatatcttccactctattgtatacgaagtaaacttggccgcctctacctatttccctaagaattgcgtctcttataagctgatcattttgttcaacaacatatgtttggacagggtatctttcttctggtggtgtttctatgactgaaatatccctaactccacttagcgacatatgcagggttctaggaattggagttgcacttagagttaaaacatcaacatttttcttaattcccttaatcttttctttttgcttaactccaaacctttgctcctcgtctactattaataagcccagatctttaaattgaatgtctttagataccaatctatgagtacctattaaaatatctaaattaccttccttcaccttttgaagtatttctttttgctgtttcgccgtcctaaacctgctgaccatgtctatctttatcggaaaatccgaaaatctattttttatatttttataatgttgctctgctaaaatggtagttggaactaaaagagcaacttgttttccatccattactgctttaaatgcagcccttatagcaacttctgttttaccatatccaacatctccacataaaagtctatccataggtttatcagattccatatctatctttatttcttctagtgatgttaattggtctggagtttcttcaaacggaaactcatcttcaaattgtttttgccattcagtatccttggaaaacttatgtccttttacagtacttctcattgcgtaaagcttaactagatcttcagctatttcatttattgattttcttgcctttgcttttgctttttgccattcagcgcttccaagtttattaactttaggtgactttccttcacttccaatatacttttgaattaaatctaattgatctactggaacatataatttatcgcctttatcataaacaatatctaaataatctcttttatggcctccaacatctatttgtttaattcccttgtatactccgataccatgatttgcatgtactacgtaatctcccggctttaattccgcaaagctcttgattttagaaattccctttttctttgctttactactttttaattttctctttgccgcaccaaatacttctttatctgatattatacatactttatattggggatattcaaatcctctcaactgattaccaaaagttattacaacttcaccatattcaattttatcaacagtatccttatagacactttctatacctctatctcttaatgttccaactaaacgttcccctctagctcgagttcctgataaaattagtgtcttatatcctaaattctttttacctaatatttcgtcaattaataaatctagctgaccttgatagttatttaatgttgtttgagctacatttactattgatagtggctttagccagccagaaacttttgtcaatgcttcgataaaagcaatcttttcatcttcaaatgattctaatacttcttctttatttattaataaatttccttgcccgggaaatatatctcctctttgagaaaaagctgtgaaattttcttcaaactctaaataagttgattctaattttccattacatctttgaacattatctactataaagaaataattcttaaaataatcaaaaagactttctgtttctttggtaaagtacggaagataactatctattgtttcaaaagacgaagtctcttctagtagttctaagtttttatttaatatttttcttagtttttctactctttcactatctttatcactttccgcaattttattaaactcttccttaagcttatttcttccaacctctaacatctcttctgaaactattacttcttttgctgggaaaatatctatctttttaactttctcaatacttcgttgagattctgtattaaaggttcttattgattctatttcatcgccaaaaagttcaactctatatggataagttgaacctgttggaaatacgtctaatatgcctcctctaagtgaaaattgacctttgccctcaaccatttccactctttcataacctgattgaattaatttctttgatatatcggcaagattaacttcatcgccttctttaaatttcatgctgtattccaaaaacaaattatgaggagtatattttgcagcaaaagcttctattgatgtcactattatttttttcttattatttaatatttcatttattacttttaatcttgcccatctcaaatctccagagatagcatcaatattatagaaaaccatttcctttactggaaaataatatacctcactagtataaaatatcaaatcttcataaagattttttgcctccatatcgctttgagttacaaccacaattgatctgttagtattttcaaatattccacttataatgtatcctcgacctgattcagatgcaccatatataccaatagggtatcttttactttcaatcccttgtattatgtcttgaaattctaaactactttccaagggctccaataacccttttaatctcatcccatgcaccttccttaaactgttgtactcgccttgaacccattgaactgattcatagctgtcttaacatcatttttaattatttccgccgccgcctttgtggacgcttctatactttcacttagaatagcagtttcttcttttgtaaatttacctaatacatgctttactaaatctccattaggttgtcctacccctacttttatccttgagaaaatttcactatttaaatgtgctataatgctctttattccattatgccctccagcacttcctttttctcttattcttaattttccaacttctaggctgatatcatcatatataactagtatctcatcgttgttaaggttataaaaatcaactacttctcttacactttcaccacttaagttcatgtaagtagttggctttaaaagcataaccttttttccatttataaaaccttctccatacatacctttaaatttttgcctgtttatttcaatattatactcttttgcaatattatcaataactttaaaaccaatattatgtcttgtattctcatactcattccctgggtttccaagacctactattaaaaacatacttgtgtcctccttagcgctcttatctaatcttattatttttatattttgtaagagaaaatgtaaatgtgactcctatattaggatgattcttgacccatacttcctcaccttgttgcataattatcattcttactattggcaatccgagtccagtactaactttgtttgttctagatttatctgatttataaaatctattccatatatgccttatttcttcatctgcaattttaggtccattattatatatctcaacaaatactttagaccccttggaatatgtactaattcttataattccattatttccgcagtattttattgcattatctaataaattagttatgacttgcattgtcttgtcttcatcagcttttacataacaattctggtctttcaaatctatttttaacattatttgcttttctcttatcttttgttcattatttataacacataatctaattaactcatttatatcgatctttcttatattgaattttaatttacctgattcaatggctgataaatctagtaaatcattaattaatcttgtaagtctttttatctcactgtatactatgtctaaataatatccttctttatcccttggaatcactccatctattattccagcaataaatccctttatagaagttattggtgatctcaactcatgagaaacatttgatataaaatctcttctattattctcaaccttttctaaagactccgccattatattaaatgaacttgccaactcaccaatctcatcacacgattctatatgaactcttttattaacttctccattagcaaaccttttggctgccttgtttatttcagctaaaggattaatcaatattttctttgaaactaatgataaaactacagatgcaaataccattgctcctaatgccgatatccatacaataagatatattctatgcaactgtttacctattgttgataaaggagctgtcattacaatatatccttgaaactcatcatcttctaatatcggatatatataggtgtaacgatctccaatatactctactggctttccatccaataaagaatatttactattatctagattctctggtttattgtctatctccttagtacttgaagttttggagtatatatatatattatcaaacttatcagaaacagtaatatcagcatttgctccaacacttgacatatccactatagcctgtaatttatcatattccaatgaatttttgttagaattgtatgtttttatagattcggatatatactctccatctttctgaaactgcaccttcttttcagtaaaatatgttattctaaaccatatagataataaccaagctaatgaaactaaaacaatagtcaaaataactataaatgttattataagtttttgaagtaagcttccactctttttcatttaatttacctcaaatttataaccaacaccccatactgtttggatttcccactgttctccactacttaatttttctcttaatctttttatatgaacatctacagttctagaatctcctggataatcatatccccatacttcacaaagtaattgctctctcgtaaaaactttatttttattattagccaaataatataatagttcaaattcctttggtggcatttttatttcttcttcattatatataactttatacgaagttgaatctattgataaatcacttaattttattacttcatttttaatattctctgaagaatatctccttaatacagcttttactctggctaacaactctttaggttcaaaaggttttactatataatcatctgcaccaatttccagtgctaaaaccttatcaaaggtgtccccctttgctgtaatcattataactggagtttccttctgttttcgtatccattttagaatatcaattccatctatatacggtatcataacatcaagcaagacaatatctggattatattctaaataaaattcttgagcctctttaccattcaaggctatctttgtattatatccagagctttttaaatacatgtctataacttcactaatgttttcatcgtcatccacaatcagaaccttggttgtaactccatccactcttctttcctccttaatttattactattacataagcattcatatcctaatataacataaatatactatttattatagaaaacaaaattatcctttaattataataaatattctaaaaatatataagtataataattatttaatagatcctattttaattaaatcataaaacttttctcgtttacaatcttaatattaacttaataaaataaatttatttaactataaaaaatagaatatatatttaccctaattacttagagtaaatatacattcctttcaatatcttatttatttaaaaactctttaaattattatttattgttgacattcaaataacttacttattggttgatcatcataaattctctttattgcttctgcaaataaaggagctactgatatagatctaattttgctattatcgttaccttcttttaacggaattgtatttaatagtactaattcttcaattgctgaagtatttatcctgtccattgcagggccagacaatactccatgtgtacagcaagcatatacattcttagcccctaaatccttaagtgcattcgctgcatttgcaatagttcctgctgtatctatcatatcatcaattaatatacatctttttccttcaatatcaccaataatattcattatttctgaaacatttgcctttggccttctcttatctatgattgctattggagcatgtaaattatccgcaaattttcttgccctcgttacacttcctaaatctggtgaaactacaacaacatcatcttgatctactaatccttttgatatataatgctcagcaagtattggtgctccaagtaaatgatctactggaatattaaagtatccttgaatctgagatgcatgtaaatccatagttaagaccctgtttgctcccgctgcagtcaacaaatctgcaaccagttttgcggttataggatctcttgatttaactttcctatcctgcctagcatatccataatacggaataaccgctgtaattctacccgctgatgcccttttaaatgcatcaatcataattagcaattccattagattgttattaacaggtgaagatgtagattgaactatgaacacatcattccctctaacagtttcattaatatcaacagatatttcaccatcgctaaaagttgaaaccttagagtttcctactggaactcctaaaatctctgctatatcttgagctaactgtgagtgcgaatttccagtaaatacttttatatttcttccatgagttatcataattgagaagacctccttaaaattttggctgatttattattaaaaaattatttttttaatccctttttatctacccatccactgatatttctttgcttagctcttgcaactgcaagatcaccttcttttacttcagatgtaatggtcgatcctgccgcaatataagtattatcgtgaattgtgacaggtgataccaaattggtattacagcctataaagctatgatctcctataatagtcttatgtttattcttaccatcataatttacaactactgtaccacatccgaaattacattccgatcccacttctgcatctcctatataagttaagtgagagactttagttccatctccaatagtagatttctttatttctacaaaatctcctattcttgcatgcttaccaattgtcgtttctggtcttatatacgcaaacggaccaacagtagtattatcaccaatattactatttaatataactgaagcttgaacatctacctcattaccaatattactatcaacaattcttgaattttgataaattaagcaattattacctatctttgtatttccctctaaaatattattaggatatattattgtatctttgcctatttcaacatcaatccctatatatgttgttctaggatcaattagagtaactccattttccatatgcataagatttattctgttcttaagtatttcttctgcttctgctaactgaactcttgaatttactccgatagtttcctcatattcagttacgactgcacctatttttttaccttgagattttaatattcctatagcatctgtaagataatactcaccttgtccattattatttgttatcttgtttaatgcatctacaagtagctcaatatcaaaacaatatattcctgaattcatctcatttatcttaagttcttcttcagtgcaatctttatgctctacaatttttgatacgccgtcattcgttcttactattcttccataacctgtaggatcattaactattgctgttaatatagttgctgaattttttgcttctatatgttcattaaatagcctttcaattgttgattgctttattaaaggagtatcaccagtaaaaattgcgactactcctttcttatcctttaagaactcttcagcacacttaacagcatgaccagttcctaattgttcagcttgcattgaataactaacatttctatctaatgttctctctttaacaagctcagcacctttccctataattacatctatatcatcaattcctgattttcttatcgaatctataacatgttttagcatttctttaccacatactttatgcaatactttaggtaaatcagattttattcttttaccttgacccgctgctaaaaccagtgcacatttatacattatataccacacctcatttataaatttatattaacacgattatttacttacaataatcggttaaatattcatatcaatttaattatattggaaagctactcttatttcaacccattagtacatttaatatttggctatagaaatactttatgacaaaacaaaaggaagttattaaaacttccttttgttaaaatcctagccttctacaacttcttctgagactgctttttcataagcttctaaaattgcagtttgtattttttctcttgcttctgtatttattgggtgagctatatccttaaattctccatctggtgtttttctactaggcatagcaataaataaacccatttgtccttctataactttgatatcatgaactacaaattcattatcaaatgtgacagaaactattcctttcattttaccttctgatgcaatttttctaatcctaacatctgttatttgcattttactccacccctcccagttgccttaaaaatatttaatattatataatttctccacaaatttctaaattccttttttatatttgataaatccttataaaatttatttttttgtgtaatcttatacaaataccaaatttctgggattgtcctatttgaatttcagaacaatttctattcacgacaacttgaagtaacaataaatatttaccataaaattaatatttttcttgttgggcctatctacaaatttaatgttcatttatatgtatactgaattaaaagtatttggaattacgcggcatctttagagtaaaattttctgttaattttaagaaaatgtttttgaaggttgtatccctataattgctgatttatcaacagcttttaactctacaatagaaacatattcgtctactaattttttttcaatttgcttattatcgactaatactcctattcctactagctcgctatcgaactctttcaataagtccttaatacctattgcagttcctccacccttcatgaaatcatcaatgaatatacatttacttgatggtttcatggacttttttgatagagacatttgttgcaatcttccattgcttcctgatacatagtttatagtaactgtaggaccttccgttacttgactatctcttctagcaataactaattgtacgcctaaatttctagcaacctcataagctaaaggaatacctttagtttctaccgttattacataatcaatctcttttccttggaaacacgatgaaagcatgactcctgctttatttattatcttaggatcatacattagatccgtcatatatattatatttcccggtataactcttccatcatcacttaattgctgacataattctaatgcaaaagctttcttctcttcttcgccactttgaggaatgtattttatcccacctgctactcctgcaattgtttcaactttacccatttcaagtctttctagaatttctctaacaacaacaatatcttcacttatagtggatttagctgcatttagtaattctgaaaatttatttaatcccaatattttatttgggttttctaataatatttttgttatggcaactaccctattatttcttgtaaacttctccataaaatcacccacacgaattttttttatattaaatcgctttaatattcatattttatgctaatttcaagttaatatcaatatttttagttataaagttaatttatatttataacttgttcacaaactcgctaaatatgcataaaatattgtgtatttattttttactatggttgattttttgaaaaatgtatataattatagttaaagtataaaactaaaaattctatactcaaattttggaacttataataacatttagttttattaattaaaaaggagttgatcatttgtctttcaattttataaaagataaagataaaaaaattcatttcattggcattggtggaattagtatgagcggacttgctgctgttttattaaatagtggttatagtgtatctggctctgactttaaggattctgcaatcattgataaattaagatcttcaggtgctgaaatttacataggtcatagaagagagaatattaataatgtagatttagtagtctataccgctgcaatcccatctgataatcctgaacttttagaagccaaggaaaaaaatattgcattaatggacagagctgaattcttagggcaaattatgaaggggcataaatacagtgttgcaatatctggaactcatggaaagactacatgtacatccatgctttctcatataacacttgctgataatttagatccaactatcttagttggtggtgaattagatgcaattggaggaaatttcagaattggtaatagtgaatatttcttaactgaagcttgtgaatataaacgttcatttttaaaattcccaccttacgttggaataattctaaatattgattctgatcatcttgattactataaagatatagatgaaattgctgatacatttttacaattctcaagacttatcccagaagatggttatcttgttggatatgctgacgatcaaagggtaaatgaaattctgtctgagacaaattgcaatactctaagttatggatttagtgacaatgctaatttaactgctaaaaatattcatttcaatacaaatggttgtgccacttttgatgtgtataaggacggtaacaacttattcaatattactttaaatgtgccaggtaagcataatatattgaatgcccttgcttcgatttgtgtttctcttatatttaatatttctaatgactgtattattgaaggattatcgaactgcaaaggagcgcataaaagatttgaatataagggaaaattaaatggtgtaactgttatagatgactacgctcatcaccctacagagattaaagccacattaagtactgctaaacaaatgaatcataataagacttattgtatttttcaacctcacacctatactagaacaaaggccctatttgatgaatttacagaatgtttcaatgatgcagatgaacttatactaatggacatctatgcagctagagagaaaaatactggacttgtatcttctgacgaacttggtgatgcattaagaaataaaggattgaaatgtatcaatgttcactcacatgatgaagcacttaattacgtaaaatcaaaactagtttctggtgacttgctattaacagtaggtgctggtgatgtagttattgttggggaaaaatacctaaaagcctaaatacttaatttgctaaataacttaggaggaatgctcatgaaaatagcaataatttcagatattcatgctaatgtctatgctcttattaatcttttagaagatattgatattgagaaagttgatacaattatttgcctaggagatttggttggttatggtcctcaccctaacgaagtaatttccatgatcaggagacgtcatattctttgcataagaggaaattatgatagttctgtagttgataatgaatattcatatataagagaaactcctattaatgctttttctcttccttggacagttaaagaattaagagaagaaaacagactatttcttgctaatttaccttcaactttaaccttgaatattgctaataaaagtctcttatttgttcatggaagtccagataaaataaatgaatatctcttaaaggacggagataatacttcagaagttatgaactccatttctaacgacgtattaatttgtgcacatacgcatatacctggaatgaaggattttaaaaataaggtatatataaactctggcagtgttggaaagcctaagattggtaggccaaatagcacttattgtattttaaatatcagtaaggaagatggaatgaaagttcagataaaagaaattccctacgcatataaaaggatagttaaagatatgacaatgttaaactttccaaaagaattgattcagagttttgaaaacggcttagaatagacaagcatgttaaataaatactcttaatataaaaaaagctttattttttataattttactataaaaaataaagcttttttatgataaattacatatatttgtagtttatatatttattttacgtattatttatactcagacgctctaaggcactggtttattatatgtttagggacaggtcctaagttgcattcaccaaaaaagtattgtaaaatctatttattatcaagggtaataggttacataaatgatattttaaaatagtgaaaaatttttttcattaataatatgttttgatcacaagattaattataaaatggaggtcatgcaatatggcaaaatcaattttaattagaagtctttacagaaatactgatgatttcttatcaaaagaaataacaatatcaggttggataagaactttaagatcatctaacgcttttggatttatagaagttaatgatggttctttctttaaaaatattcaagtagtttttgacgataagttaaataacttcaaagaaatatctaaattacctataagttcatcaatttcagttattggtatcttagttgctactcctgaagcaaaacaaccttttgaaattcaggctaagaatattattatcgaaggtatgtcaaactctgattatccacttcaaaaaaagagacacacttttgaatacttaagaacaatagctcatttgaggcctagaagtaatgcatttgctgcaacttttagagttcgctctgttgctgcttatgcaatacataagttctttcaagatcaaaatttcgtgtatactcacacaccaataataactggtagcgattgtgaaggtgctggagaaatgttcagggtaacaacgcttgatcctaaaactcctgaattaagtaaagatggaagtgtagatttcagcaaggatttctttggcaaagagactaatcttactgtatctggtcagttaaatgctgaatgctttgctttagcgtttagaaatatctatacatttggaccaacattcagagctgaaaattcaaacactacaagacatgctgctgaattttggatgattgaacctgaaattgcctttgcagatttacaagatgatatggaacttgctgaaaatatgcttaaatatgttattaaatatgttatggatgaatgtcctgaggaattagagttctttaatcaatttgttgataaaggtttattagaaagattaaatcacgtagtttcatcagattttgctaaagttacgtatacagaagctgttgaaatactacaaaagtgtggaaagaaatttgattacgatgtatcatggggcattgatttacaaacagagcacgaaagatatcttactgaagaacactttaaaaagccactatttgtaacagactatcctaaagatattaaagctttctatatgagattaaatgatgatggaaaaacagtagctgctactgatcttttggtaccaggaatcggagaaattataggtggtagccaaagagaagaaagactagatgtgctaaaagatagaatgactgaattaaacctatctgaagatgattactggtggtatttagaattaagaaaatatggagaaactaagcacgctggttttggtttaggtttcgaaagattaattatgtatataacaggaatgactaatattagagacgtagttccattccctagaactcctggaacaagcgagttctaattactcaactgttaattttatattatcaataaagaggggtatatcgattaattcgatagctccttttttgatattatgtaatgattaatttaatatatatatattgcaatagtaactttgcatttaaaattctatcaagttagttagcaaattaagatttatgaactaatccaaaacatatttatattaaatttttccaccttgtattctgcttgactatctttatatggctattatacttctatagatttatttaaaatttatttcatctgtaatctatacctgagtattcttttatatgtcttttatatggcaattaatctaatattcgcttataaaaacattacatgtactaacaatatttaaaattgtatatattgtattgattatctatacataatacatattataattcagatattagtataattttatttataaaattaattaaggagataaccaaaacctgattatctccttaaattcagttgatttttattctattacttattgtcttcttcgaattttctcatgaattctactaaatctttaacaccttcaattggcatagcattatatatacttgctctcatcccaccaactgttctatgtccttttagattttcaaatcctactgctttagcttcttttacaaatttagcatctagttcatctgaacctgttacaaatggtacattcattaaagaacgatctttctttacaacagttcctttaaacatgctacttgaatcaagaaaatcatataaaatagaagctttttcttcattaattttcttcatagcttctagtccacccttattcttaacccatttaaatacttttccgcatatatatattccatatgctggtggtgtattatatagtgatttattgtctgcatgaaccttatatcttaacattgttggagtccctggtaatacatcttctgtgattaaatcttcacgaattattactacaacaacaccagctggtcctgcatttttttgtactcctgcaaatattagtccatattttgatacatctactggctcagataagaaatctgatgacatatctgctactaatatcttatccccaacgtttggtaattctttatacgtagttccatagattgtattgttatgacatatgtaaacatagtctgcatcctctgaaacttttaaatcctttaaatctggtatatatgaaaaagttttatcctctgaagacgctaatatattaacttttccaaatatttttgcttctgacgctgccttttttgcccattgccctgtaataatatgatccacaactttatttttcattagattcattggaatcattgcaaattgttgtgatgccccaccttgaaggaataataccttatagttatccggaatattcattaattctcttaatgttttttcagcatcggtgatgatttcttcgaacgctttagaacgatgactcatctccataactgacatgcctgtccccttgtagtctagcatttcccccgcagcttctcttaggactgactccggtaatacagctggtcctgctgaaaaattataaactcttgacattgaaaaagccccctttgatatttttatttgtaatctataatattataacacaatttaaatatcaagtaacaaaattatcatttattgatataaaaagttaatggacttatatatacttaaatctgctaaaatacttaatttattatcaattatgagtttagtatcttatatcaaatctgttgtataaaaatctaattatcagacctgttttctaactagtagttagttctattttttaaatatgttaaacaaaataatatattttttcatcataatactataaatacgccaattttactgatatactactattatgtttaacatttaactaagaattatgttgtaaattgtactataaccaacatttgaggagaagataatatgagattaattccaattgaatgtgtaaaaccgaatacagttattggtaagacattatacgattctgatggtagagtattagtaagagctggtatggtccttagtgaaagaattatttttaagataaaggatttaaatattttatcaatatatataattgatgaatttagttctgatgaaattgaagatattattaaacctgaattgagacaaaaagcaattctaacaataaaagaagctttttcaaatataaatagacttactgttgctgataagttttcaaaaaatgaatcagtatatttcaataatattgagtctatggctgaagatttaattgaaaatgttctaaataataaaagtgtcttactttcactaatagacataagaagcatggataattatatctactctcattctgtgaatgttgccgtaatatcactagtccttggaattgcattgaagcttccaaaaagacaacttcaatatctttgtattggatcattgcttcatgatgttgggaaaacatttattccaaaggaaattcttatgaaagaggaagaactaacggatgaagaagttacaatattagaccaacatccaatactcggatataaatatttatcagactcttataatctgagcgctaatagcaaaataataacactacagcatcatgaaagacctgacggattaggttatcctaataggctagctaatgatgagataagtaccttaagtaaaattgtaagcattgctaacgcatatgactctttatcaaccggtagacctaataaaagagcaatgtttccaagtgatgttcttgaatatttaatgtctaatgcaggcaaaaaatttgactatgaaattgttaatatattctgcaaaattgtaattcccttctcaaaaggaactttagttgatctaagtaatggtgacatagctgttgtgcaagaaactatacctaacttcccactaaggcctattgtaaaaattcttaaaagttctagaccaggtagggttaacactgaaattaatttaataagcgaaacctctgtagttatatcaaatataagatatgaattataaaataatgaatattaagattacaattgaataatattgttaatttatttggttatactaatcattggaggcgattttatgaaggatatactatatcttgtaattccttgctataatgaagaagaagttttacatgaaactagtaaaagattgctcgtaaaaattaagactatgatttcaaataacctaatatctaataaaagcaaaatactttttgttaatgatggttcaaaagatagaacttggagaataattgaagagcttcattccaaaaataatatattttcaggaatcaacctttcaaggaacaggggccaccagaatgccttacttgctgggctcatggttgctaaagattattcagatatgactatatcattagatgcagatttacaagatgatatagatgtcatagatgcatttgtagaaaaatattatgatggatgcgatattgtttatggagtaagatccactagagaaactgatacctttttcaagagaacaactgcattaggtttttataaattaatgcgtattcttggcgtagacatggtctataatcatgcagattataggcttatgagcaaacgtgttgtagacgggttaagtcaatataaggaagttaatttatttcttcgcggaatgattccattaataggatataaatactcagttgttgaatatgaacgtcatgaaagatttgctggtgaatctaaatatcctctaaaaaagatgattgcctttgccttggacggaattacatcctttagcataaaaccaataagattaataaccctccttggttttactatattttttgctggaggcgcagccctaatttatactcttatagttaaaatttcaggccgtacagttactggttggacttcattaaccctttccatttgggtacttggcggagttcagctcttatctcttggcgtaataggagaatatatcggaaaaatatataatgaagctaaacacagacctagatttatcatttctgataaattaatcaatgttgataaagaaaataagtaatacaaagatgacaatacatgtcttaattaatccatgtactgtcatctttatattactacttttttatagacttagatatatttctattaagatctgatactgatataattccttttttcctaagcatttgtacattctcgagtatttcactaaacgatataatattttctttagtaacttttatttttaaagatgcttttctctttttatatttatacgtactaaaatttctattaattactctagtaatcataaatctatctcctataaaaaatatctcatgatagatttatcgtattaaatatattactctttatttctttttagtaaaaatttgtattttagttaaatgcttaataggaattacattaaaagtttgctactttttcgatatgtatttatttccctctatataaaatctccatggaaaatctattgcttcttctgcataatctattccgattcttttcgtttccactattttaaacgtatctttttctccttcttctatataaaaatcaccttcatcgtataaccttttataattttccgatttatctattgaaaatgcaatacacagttttgatggtccatttgtaattgcctttttctttgtttctgaaagttcatcataattttgattaaaccttttttttgcaagataatcaaattcatttaacggttcaaatgctcttattagaactccctctcccttatcttctaatccacttataacattaaaacaatagtattttccataaataaaataaacataagcaatcccaccttctctaaataaaggttcagttctttcagtccttcttccattataagcatgcgatgccttatctatttctcctatatacgcttctgtttcaacaattttagctcttaatgtcactccgtcaacctttcttataataacttttcccaaaagttctttcgctaaaattaatgcaccttgtttataaaattctttattcaaaatcaagcttcattcacctaactttcactataagtaatataacttatattgtgatatatgggcctattttattactccaaaatttatccacatagttcaaataataatccacaacttttttaattatactcacacatttgtggatattttcaaaaacatcttatattaatgttaaagttctataataacaatttgttctttttttatactttctttaacatctattattctttgattagttgaacctctaaacttaagtccatctgacatcttactttcttcaaattttccatctacaagaacatcaatattgtttaataaatcactccagcccaatctcgaatccttattttctaaaatatattcataagtatatcctgtatagctccaaatatttaaacctttttttctaaactcctttgccatatatgcaaatttatctgcctgttcccacggatctccgccactaaatgttactccctttataatttcattatttaatgtatcattaattaattcatctatatctctttgctctcctccataaaaatcatgagtatcaggattaaaacaacttttacagttatgcttacaaccttgtgaaaaaaatactctccttataccgggcccattaactaaactctcatatgctatccctgctaatcttatagtcttttccattaaacttacacttctttctcatcaatctatttatatacattctattagataattaattataacgtaagtataatcacatttacaaatcacctgcctattacacctatcttgaatttgaattatagaccttaagcatttacatgcttattggtataaaaaaatgcagagtcttaaagaccctgcattttcactctttatcttataattaactatttgctttaacgtaattaagtcttccgccttctttaataacagcaatttccttctctgttagatcaactgttgcctcaaattcagttcctttagttaagttcttaactttaactactcctgattctaaagcagcttggatatcttccatcttcaagtcatcaactaaatcaatcttttcataatcagcttcattcttaaattcaattggaactattccattatttattaagttagctttatgaattcttgcaaatgatttagctataacagccttaactcctaagtataatggtgcaagtgctgcatgttctctacttgaaccttgtccgtaatttcctccagcgattataaatccaccattaaattccttagctctcttagggaattctgtgtcaactgtgttgaagcagtattctgcaaggtaaggtatatttgatctaaatggcaataacttagaattcgaaggcataatatggtcagttgtaatattatcttcaacctttattaatactttaccatctaattcttcagctaatggtttgcttactgggaatggcttaatatttggccctctaacaacttcaacttcagcatttgttggtgctggtgctaaaatcatagaatcatctattaaaaattccttaggcatatctattgttaaatctacatccacttcggttggatcagttaaaactccatttatagctgaaactgctgcagtttcaggactcactatatatatttgtgctgataatgttccacttctaccataaaagtttctatttacagttctaagggaaattgcatcagttccaggtgattgtcccataccgatacatggtccacaaccattctcaagtattcttgcccctgagctgattatatctgctaatgcaccgtttctagctatcatttccataacttgtcttgatccaggtcctattactaagctaacatctggatgtacttttttaccttttaatatcttagcaaccttcattaagtcttcataagaagagttagtacagcttcctataactacttggtcaactttaatcttaccaacttcgctaaccttagctacattgtctgggctatgaggcttagctgtaagtggtgtcaattcacttaaattaattgttactacttcgtcatatacagcatctgcatctggcttaaattctataaagtcttcttctcttccttgtgccttaaagaattctaaagttctttcgtcacttgggaaaatcgaagttgtagctccaagttctgctcccatattagttatagttgctctttcaggaactgaaagtgttttaacaccttcaccagcgtattcaaatactttccctactccacctttaacagttaatattcttagaacttctaatataacatctttagccgctaccattttattcaattttccagtaagctcaatcttaactaccttaggagtattaatattataagctcctcctcccatagcaagagcaacgtctaatccaccagctcccatagcaagcataccaacaccacctgctgttggtgtatggctatcagaacctattaatgtatctcctggcgttgaaaatctttctaagaatatttgatgacatattccattccctggctttgaaaaatatactccatatttagatgcaactgtttgaataaacttatgatcgtctgcattttcaaaaccttgttgtaacatattatgatctataaatgctactgatttctttgtcttaactctatctattcccatagcttctaattgaagatatgccattgttcctgttgaatcttgagttaacgtttgatcaatctttaatgctataggctctcctgcctttaattcaccttcaacaatgtggctttttaaaatcttataaactaaattatctcccatgtttaatccccctattattgcttatttctttcttctaatcgtctatgatactctttatataattgaactacttctttatcaaataaagttctctttaatctaactgatgtagctcttacaagttcaagtattccttttgcttcatcctctgtaagttctctattatattctctaaatttatttattattgaagctcttcctgaatgctttcctataacaatttgtctttcaagaccaactatatctggatcaaatgcttcataattcttaggatcctttattgctccatctgcatgaattcctgattcatgtgcaaacatatttgttccaacaatggctttccagattggaagttctcttcctgatgctcttgatacatattgtgatacttctctaaacatttgtgtatttattccatcaccgttatatccgtaaacaagcattaatgccattataacttcttctaatgctgcattacctgctctttctccaagaccatttacagttactccaacatgcgatgctccacccttaatacctgctaccgcattagctgttgccattccaaagtcatcatgagtatgcatttctatatcaaagcctgttttatcatatatatatttaatatcatctctaattttaaatggctccataattcctacagtatcgcaatatctaaatctatctgcacctgcttgtttagctgcattaatatattcaactaaaaagtccttatctgctctagatgcatcttccccattaacagatacataaagaccatttttctttgcaaattctacagatttaaccatgctttctaatacccattctctagatgttttaagtttatgctgaatgtgtatatccgatactgatattgatatggcaactgcatcaactccacaatctattgattgttctatatcactgactactgctctattccatgccataatactaggttttaaatttctttttacaatttcttttatagccttcttttcgtccccacccattgtaggaatccctacttctagctgatcaacacctaagtcacttaacatttctgctattactattttttcttcattagcaaaaaccacccctgctgtttgctcaccatctctaagagtggtatctactatagaaacttttttattagtttttaaattactaagtgccattttagtccccccatttatattattttcttattacttaaagcatatttttaataaattaacatttttactgtatatttataatatcatatattaataaatctatacaagatttattttatttttttgcaacgaaacagctactctccttcatgtattttcacattttaattgtttttaatgaaaattctctcaattattgcaagttttttttttgatgttgcaatacattgataaattaacagtccattttccttagcagatttacccaaagcatttagtgttcataccaaatagttacattatattctctattaatttcattaatatattaaagtttactttttatacctctattttttaataattcttatagaaaatatgtttttttgcttccttaatatataacttctgtattatataactcattcctcataaaattatttgttccatattgccttataagccaatataacatctgatgaattaaatattttgaaatatatattgatatatttttatataaaaaaagaagatgagattaataaatccatcttctttttctatattataatttataaattaaaaatctatcatcattatgcttttagtagtgatgcccatgtctctcagtatgtgatattctatcttctctttcatgatactttccagcaccgaatctttcatctaaacttaaatatcctgtaactcttgatattccttgaatattctgactaccacatttaggacacttgttttcattgttttgaagataagtaccacattctctacaatatcttatatgaaagttaattcccatataactaatattagtatttttatatgcataatttattatatccattattgtctctgcatctggtgtgtcgtctacttcaatataacttatatgaccaccattgcaaagtttatgatacggtgcttcaatttcaatcttatctttaatagatattgggtacgaaacaggtatatgataactatttgtataatactccttatcagttactccttttattaatccaaatatcttttgatcttgctttataaatttacctgaaaggccttctgctggagtagcataacaactccaatttagtttatattcctctgtaagtctatcacaatattgtcttatatgttcaacaatccttattcctaattttcttgcttcttcatcttcaccatgatgctttccaattaaagctaataaggtttccgcaacacctatgaatcctattccccaagttccttgctttaatattggttctatagaatcatcaggctttaatccttctgaacctttcataagcccttggcctgcaacaaaaggtaaatccttaactcttagattctttaaaatctcatatctatgcattaacgaatcttttgctaattctaatcttgcatctaatatactgaaaaacttatttatatcatttttagcttgcaaccctattcttggaagattaagagttgttggtgctatattccctcttcccttacaaccaggctcaccatttacatttttcataagataagttctacatcccattgtagctggaacataacctttatcgtaatattccttattaaaatctgcatcaatattcataaaagttggattcattctctttgcagctactctacatgctagtttgtataaataaaaatattcatcattctcttccctattaacgcctgacttaactctaaaaattatattaggaaaaattggttgttcacctttacctaatcctttttcatattctaaaagaaaaacttcacatactaatgctgcatctgagcttgtaggtaaaccaatattgattgaactaaatggtacttgagatcctgctctagaatgcattgtattaagattataaactacaccttgcattgcttgttgtaccttttttcttactttcttttctaccatagcttctaacttttcttctgatacacctagttccaataattcttctctaatttcttctctagttggctctacaaatatacccatgtcattatcaaaatccggatgagattgaccaccaaacatatcattttgagttgattgcaataatatacatgataattcagcagcagtttcaattctcttaggagcattaattgttccatatccagtattaaatccattctctaatatctcttttgttggtatatgcaagcagtttacagttaaattatagctatctaagtcatgataatataaatcaccattctcatgagcctttgccaaattttttggcatagtagctagtgtattccacttatttgattcagatgctattcttaataacttagaactgaaattatttcctacatttgcattatctctatcagtttcaactccaatttgtcttatagccttcattaaatctgattttatatctctgactttagttctttcacgtctgtatgctgaataagcgactgctatatctttgtgtccctcatttcttaatgctttctctacaaaattttgtatttgttctacagttatagtcttcttatactcttcttctatataagtaatcaccttatgtacagtatctagaacttgactttcttttaaatttaaaccgatttcactagctgatcctttaattgcttgagctatcttatctgaattaaattcaacttctctcccatcgcgtttcacaacatatagcattattattccctccatggcacaatatatagtatttttactaccgtactattatactgtattaggtattcattagcaacacttctaattttttatttttaaaccactagattttaattatctcaatttatatcctattatctttcgatttattcaatttttactacttttttatgtttgacttattgtagataatctttattgttgtaatttactatgatttatagtattttttcataacaaactataagaaaattattattatatgtgttctaaaaagttaaattgattaaaatttactgtaaattatcatcttgtgcgaaccaaaaagttttatgaaaaacatagtttattatctaaaaatataatataaattatttctttaagtaatatataagaaatgtattttttacaaatagtgttataattaaactaagactatatatttctaggaggaactaagatggataaaatagcattaataactgatagtgcttctgatttgaatacaaatttcgtaatagaaaataatattaaaatagtcccgtttaaaattatattctctgatagagagtatattgatggaatagatataacgccaaaggccctatatgaatatttgcctaaggagatacctaaaacttccttgcctggtgttgaggattttacagctgctttagagcaagtaaaaaacgaaggatatacacatgcaattattataacaatatcaagtggcctttctggcgcttataactctgcaagacttgcatctgaaaatgtccctgaagtaaaaactttcgtatttgattctatgactttaactatgtcagaaggcgctatggtcattgaaactctaaacctaataaagcaaaggaaatcctttgatgaaatagtaaatactttaccttcctttagagataagattgacgtgttttttacaatagatacattagaatacttaataaagggaggccgagttggtaaagttgccgggactatagcaggtgtacttaatttaaaacctattattactgttggagatgatggtatatatcatacagtttgtaaaataagaggcataaagcaatgcatatctaaattaacaaatatattaataaattatctagaaaatcataggtgtaaagtttggattttagatggggatgcacctgagaaatccaaaatgctttatgattctataaaagaccttcctaatctaattgaatgtattttaggcggatcaataggacctgctcttggcgttcatactggacctggtcttgttggattaatagttgaaagattagattaatcgaaaaatatctatgttaactatttactcataattaaagagctaaatattaaaattcatatttttttatttagctctttaaccttttacaggtatacttacttttctacttgtaaataataataacaaagaaatctttactgaaaggactgttttgttattatgaaagattttatattagattcaacatatagagatgctactattgttaatagaaatgatgatatcttcaccatttcatcaaatagattaccaaatagcacaatcccacatcattctataaatttgattgcttctagctcaaattcacattccaatttaagtaataataacaagtttaatacatacaatctaattgactatctataataataggtataaaatagtataagtgtaatatatttataatgtgctaggggagccgagaggctgagatttgatattcataaacccttaaaacctgatctagttaattctagcgtagggaatgcaacctcttaaaaactttaaactatttatttggttgataatctccgagcacaattaaggaggttttttttatgtcaatttttaatgattggatcgaacaattttctaaacttttccaaaatttctcgcaaaacattcaagatattcttgcaagtccaatgtctattataactttattaggatgtattttactgcttatagtattcgctaaggcaaaaaagataaaattcacgccagaactaattgctagaattggtatagcattagcgttagccactatattaaaaatgctaagattatatcattttcctcaaggtggtagcataactttaggcagcatgataccagtattgctcatagcattcatatacggtcctgaagttggatgtttaacaggatttctttatggtgtaataaccctaatactggatccatatatactacatccgattcaagttttatttgattatccattgccctttacagcattaggtcttgccggattcttcaaacaaagaagattagttggagtgagtattgcaatactggtcagatttttatgtcatcttatttctggtatagttttcttcgggtcatttgccccagaagggatgtccccagtagtttattctttacttgttaatggtccaatgattggaatagaaggaatcatatgcttagtaattttagccgttcttcctatagaaagaatttttcatgcatcatcagtaaatactatttcaaactaattgtatatataaaacaatttatatatacaattagtttcgaagccatacttagtaactaaaaatttcacttatcagcattttaagcttattaatgcaaaatatatagaataaaaataggattaattttgttttataaaacaaaattaatcctatttttgatcaaataataaataactattatttataaattatttattttagacgttttagttgtattttgcaatcaaattttattcttctatttcaattgcatttactggacagctttcttctgcttcttttgcctcatctacacaaccttctggaacttcatcaactatagctcctgcttttccatcatcttgcatgtcaaagcactctggacatatagatggacataatccgcaagctatacaagtatctttatctacttttggtttcatggtttacttcatctcctctaatatcaaattacaagcttattatttcccaagaaatattaagttatgtatatttaataatataatttaaaatgatgaaataaatatagtataaggaaaagaatttttcttttaatacaatccttcaaatattagtgaatataacggattctccttaacgtattcctctgcttttccttgctccaatgcttctgtaagttcaatattaattggtaactctcctattaaaggaattccaagatactccgcattttcttctgatgactttctgctaaatactcgtatctttttatcacaatctggacagtttatatatgccatgttctctactacgcccttaatcttcacccctatcttttgggccataataacaactttcttgactatcatggacaccatatcttgtggtgtagaaactattacaatttcatcaatagggaattcctgcattacagttaaagcaatatctcctgtacctggtggcatatctataagtaaatagtcaagctcttcccaattagtttctacaaacatctgctttaacacccctgtaattacaggtcctctccagattacaggttcatcttctaccgctgttaaaagattcatggagattatttttatcccgctttctgtttccactggctcaaattttaccatatcattttctaatggaattattttagctcttttattgttaaccccaaaaaatctaggcatagatggacctgtaatatctgcatccaacactcctactttatatcccttcttagataacatacttgccatcattccagttacagttgatttaccaactccaccttttccacttataatacctataacatttttaatatttccatatctggatattaactttaaactttcttcactacatcctgttcctttagattgacatgtgtctttacttttacaactttcacaactcatttatatatgctcctttacttaccaatcttgtgggaccttattaggctcacttattttaatatcccagtctttataattatattctgccgttacatagtaactttcaaaggaattatcctttttattatctactgttattagtgttttgaaaacagtactattatatcctctattttttactttaattattgtatcaaaatcttcataattattgtttactaaatcaacactaggtaaagttttgttcaaacttttcttaaaatcttctaaatccacagaaaatatgtatttcaaacaatctgtatctccagctatgttcactccaactttgtttccgttggataagctatcttttttcttatcaataacttttaatattgattgataatatatataattaaagtctcttggctttcttatgaatgaaagattttgcattattgtattctctaaatttttaggtactgaaaatgccttatcgtcatcataaaagtttcctgtcccatgttcgttagctccaactacatactgatactttctcacttcatctccggtacacacctcaaaaatataatctggatctaatgagcttttctttgaaacttcacttccatctgataaaatcttgtaaatgtcatctatggctttaggatcattaactacaaacctaaatccactatctctaacactttgtataataattttatccaccttattttgctttatataatcaaattgttgatttttaagattcattttaacttctatattatcaatgaagctacatcctgagagcatcatactagagaccaataccaatggtaaaactattgttaaaaacttactatttctcactgttcttcttcgctcctttgaaaatcctatggttattaaatacaacaataccaatcaccaaagtaaatattgcgataaattgtgatgttgatagaatcccgatactccctcttggatcatctcttaaaaactctactaaaaatctacctatactatatactattaaatatagtcccactatctttcctgtttgtttttctttcttactatagtacaaaagtataaatcctagcaaaaagtcaaatattgatgaataaatttgcgttggatgcacgtgtattcctgctggtgctaaagatccttttggaaatgtaacacctattggtaatttggtttctgctccataacaacatccagccagaaaacatccaattctaccaaaaccttgggctattgcaagacctggaaccgtcatatccaacatttcaacaatgttccaagactttttcctagaatataagtacatagccaaggctcctccacctatggcaccatatataacaaatccatatccaaagttcagtaatatgcttggctctttaataatatctttaatctcagttaatataaataatccctttccaccaagcgctccacctattacagctaaaattactaaatttaataaagaatcctcatcatagccttttttctttcctttatttataaatatagcagctgcaactattattccaattgcaatcattaatccataaccctttatttgtatcccaaatatctcaaataatattatcctcattgctcgcctccaaacgtcaaataagtatcaaggagaagctattctggcctctccttgatacttaaattataatacttatgcttatccttggcaaatcttatttaactcatcaactcaacattcacacaattatatattttatatcaaacatataatgtagtcttttcatattaaccacttataatccataaaactttatataaaataaattggctaatttcaactttgagatgatttaatacttgaaataatcgtatttaaaatagtcttcatattatccttataatcctttgacttaagattaaataatatctttgctgttttaccttctcctaaatttagataatagcattcattgttaaaatcatatccattctttacttttgtttcatatttaactaataccccagaattataggaatttttaaaagatgttaattctgaattataatattctagacattgactatttaaatctttttctgcaaacacgtttatatcctctttggtatttactacttgcaataaaccagtaagcttattatttttgtctttaaaatccaattcataactcacatattgccctttactttctttttcctccacattccattcacttggcagagatataacatatttattatcgtcaaaagaatattctttaaatttgcttatcccctgatccataagaattacctgttcgaaattttctttaaagaagccctgggttatgaccagtatcaacatcaatgataacaatattgacgtaacaatcaactgcttcttattcataacaatgttctctatcttgccggaattacgattgaagaatttttaaaatcatagaacatcaaccaatatccttggccattattaccatcattagtccatgttacgaaacctgttcttccaccatacggttgatcatttttttctttgcttcctggtattgcatatataatatattgcatttctccatctttattacatttatatcctaataagaaatgtcctgttttactaatgtaaggataataatttaacattggataatatgctaatgtatatttgttataatttgaatcatttgataaatcttctataccatttacaatgattttataccacttacagaagtttatatcattcaattttccaataaacggtttaaaatcttgtgctaacttctcaaaatacttacctatatctccacttatagtgaatccctgatttgaggcattttgattattattattttcatttgatgtatctcccatatttaagtctagctgtcccatgcctccggtttcaccgctagtctctggctgtcccattgttcctgtgttcatttgattcattccagcatttgatgatgtttgatctgttacagtattagtgcctgtctggttcatatctcctgtgctagtctgatttgccgagttccctgaccatggttgccacattgttcctgtatcaacctggcccattccagtatttgagttgccttgctccatagactccactgtaccagtcgtattcatcgtagatgtatcatttgctcctgtggctccacctaaatttccttgttgaatattattttcatattcatcgaaatctattatgtccattctgtctgatgtatccacgtcattcaatttatccaatttaaagttttcttctattctcctagagctaacttgcacattatctatatcctgattttcatttctacatttcttttctaatttgaatttcttccatttagaattatgattcttcttatcctttataaatccatatactataacatcttcatacatgtgatgacttacttttagatctattacaccatcataagtatctaatttcttagccattttaccaataacatcatctatatcttcttctttttcgaaatagtcatacttatcatgtttatcatatttatcacacttattatatttttcatctttatcccatttatcatatttgtcgtacttatcatatttatccgctttatcatatttgtcatgtttatcgcacttatcttctttatcacatttatcatgtttatcacacttatcgtatttttcttctttatcgcatttatcgtgtttatcacacttatcatatttgtcttctttatcacatttatcgtgtttatcacacttatcatatttatcttctttatcatgcttatcgcacttgtcatgtttataatctttctcacattttttgctctctttattcttgtttctttcctcatctaaattatctatagtttcagttatgttttgatgatcttctggaatcctattttgtttatcttcaactttagattctatgttcgctttaggttgaagatcaatatcatctttttttcgttcaactgattcatcttgtaatttaggtgcctttactaattcatcctctttcgtacctgattgagtgatagttttatttaatgtacttacagtcaaattttctttttccttagtttgtaatgttgttttatcaacatatttcctagaatcagcttttataatcttaaactttctccaattatcagcagattcttctccattcataaaaccatgcattacaaattctgtttcattatcttttaccctacatatagcagcaccagatattttttcataagatattccaagactagctatgttatttacataatattctttgctagtatctccttttccgacttcatttattgctaaaggtccaatatcaattaattgttttaaatccttcttacaacatataagtaccatggaataattatcttcctgcctaagattctgcgcataaaatgagattttacacttatcacctttagcctccaccttagcatatccagacaaagctttatcattagattgagaatatcctctttcatcttcttgtaatattataaagtttctatacaatttgttgtgtgccaaccctatattccctccacatatatttattccatatagtatatgtttggaaattagaattatgatttaactaatacttttctatattttcatactctatatagcccagcaattttaatagaaactaaaaagtagagaacgaataattcaataattactcattctccaccttttagtttcttatatcatatatacaatctgataaggccgcaaattcttctaatgttaatgtttcagctcttctcttaggatcaattcctgatttcttaaatgcttcttctaatttctctttatctacttttaatgtttttgctgcattccataaagtttttcttctcatattgaaacctgctcttacaatctcaaacataatattgatatccttagttttaactcttggttcatctaatctatctagtcttattactatagattcaacctttggtctaggaataaaacaagttggtggtaccttccttattatgtctgtattacaataatactgaactaaaaccgacaatgcaccatattccttacaattaggttcagcattaattctctctgcaacttccttttgaatcattatagttaatgatttaaaattatatccaccttttagaagcttaactattataggggttgtaacatagtatggaagatttgctacaagcttaacacttttctcatctccaataagttcattaaaatccactttaagtgcatctttatgtattaaactaaaattcttgtgctcccccaactcttgctcaagtatcggaattaaatcattatctaattcaatagatgttacttttttagctttcatcaaaagttgagcggtaagcgtacctacacctggtccaatctctataataaaatcttcattgttaacttctgctccattaactatatcatcaagaacagaatcatcaactaagaaattttgcccaaggctttttgagaacttaaaattatattttttgactagttcctgagtttttatatcttttaaatccatttatttcttacctacttccaattgtttttctatttcttttatagcattagtaaattcttctttagttattccataattatttaatctagaaaccatctgcgccgcatttccataacctattcctaataacttaccaagcatatttcttctaatctttgaagtattatctcctgtaagcttgaaataaaacatatcctgcatagtaaaaaatgattgtttttcttcttgtgttatctttgccatttcaagcgccttcaaaataacttctgggcatgcattttctactccaatatctccgttcttaagtccatcttcttttgcaatatatgcatgttttattcctttaactctttttgctattattcttcttattttttcccctgcaaaatctgggtctgttaatacaattaccccttttcttttctgggcctcctgtattcttgctatgacctttgcatttattccaaatcctcctacagcgattatttctgcatctatagctttctttacagcgtcaacgtcatctctaccctcaacgactattacttcttttatcaatgtgttacttcctttctttattaataattactttattgcattcatatatctataccataaaatagccttaaatttattttatctcatttctaataatatgataaaacatccacaaattcaaagaaaaaaatagagataacatctgttatctcttaaaatagcttaccattgccctgggtaagcaactactaatacatcaactggtcttcttccccacgaatcacattcatttgacgaattaaggtatatgtcaattctgtcgccctttatagcaccacctgtatctgatgcaattgcatatccatacccttccacatatactttacttcctagtggtattacggatggatctactgcaatcgtactcataccaccttgatttctaacaggcgttcttcctgtagctgtagtagaatggttactataagctgttgctgtgcaattaatctttttcttataagttattctgtctccacctctgcttgcgtacacttgaccagttcctttgaccacaacttcattttgtggttccaatatggttttagtactctttacattacgagaaatttctaccccatctttatatattatttgataagtaatttgtttctcaccattaactccttcactcttaaccttctgaacactactgtccaaattttcatctttttctacaattgtatcgaagttaattggctgtttttcggtgacatcttttgtttccactttgacaagttggacactttcgttaccctctaacttagactctagggatggtgatacttcatctacgtctttgtcaaattctattccttgatcttttaatgtatttttctctgcatccagcatatcctcaaccgtatcctctgccgtttgcaattgtacttccattccaccagccttaatatctactggaacagccttttttactttaatagtttctttttcagatactttggattccaaggacggttgcactttatctttaggcgatacttctatcccattttcttgcaacacacctttaacagtccccttgtaagtgacaaaagtcgcttctttaccgtctatacttattacgagcgtttttcttatgctcattatagtcactgctgtaacaactacaaatgctatcgcaattgttccaattataatttttgccttcggaccgttagaaaaactttgcctaataaattgtctcaatttttctatcattattttccctcctttggcaagagtgtcttttgaattatatattaatattctagacttgtcaaattagtaaactcttgcaatataatgaagcattgtaataatgcactttgtgcataaaatataatatataaaaatgatagcggtatttaatattacttcattatgaaattaaaaatttaatgatatgaaattatagaaacatttattaaacttaatgataatttcagtttaatattagatttactttatgttgaatacagaaattatatttaaagtgtacatttaatattttaccttatttttcctttcttatcaatctaaaaaaattctcgttaaatctcaaatttgcctcataagggtcaatattcttaatttctgctatcttagttattatatattcaatatagtctgatttatttctctttcctctgtttggttcaggtgccatatacgggcaatcagtttctacaagtattttttctaaagggatttctctaactacttcaacaactttttttgcatttttaaatgtaacaacacctgttattcctatataatatcctagttttacgcattcccttgcaaattctacactccctgaaaaacagtgaactacacctgtaacttctgggaattccttaattatttctaatgtgtctttatgtgcatctctatcatgaataacaactggataatttagttctttagctaaattcatatgacttctaaatacatccttttgaatatctttaggtggattttcatcccaataatagtctaatccaatctccccaatagctactattttgtcattattcttaatataagatttaatttcatctagtgtatcgcctttcatctcattcgcattttccggatgtattcctaaagctccaaagataaaattatgatctttagttagtttatctgttgtttttaaactatcatatgatgatgcgcaatttaggattccaataactccattttgattaatctcatttagcaagggctccctatcttcattaaaagcttcatcatcataatgagcatgactatctattattttaaatttttgattcataaaccaatattcctttcctattaacattatttccaaattgtcatattctgaaactactgcatttaaatttaggattacttatttaaataataacataaaattattacttatacctctttatgatagctttacttaaaactatatgatcaaatgcaaatcgtagcaattaaaataaaaataaattcgtaaatactaatttttttacgaatttattatttgacacttaaatgacatattaatgcattaaaattaatattgtaaagtagttaaagcattattatttaccccttttaaccatttatttagtatggttaatgaacgtctcactcccctaagtgagacgttctattttttataattatcttacaatgctacctgttggaatctcacctggatccactgcttttaatatactgtcatcatctgttgcagcacataaaatcattccttgtgataattcgcctctaagttttactggctttaagttagcaactaaaactacatttttacctactatttcttctggtttatagaacttagatattccagaaaccacttgtctttcttctccacctaaatcaacttttaattttaatagtttcttagctccctttattggttcacatgctaatacttttactactcttaaatcaaccttttcaaaatcatctattgttatttcttcttttataggtgtaatttctctcttagctggtgtttgagcagcctttaaagcttctaattcttctaatttcttatctacatctattcttgggaataagttgtcagcctttactaccttagttcctgccttaattccatcaaatgactttaatgattcccatgaaatttctgtagtattaatttgctcattaatcttcttagatgtttctggcaagaatgctgaaatcattactgatgcaaatcttaagctttcggctaaattataaagaactgttccaagtctagcctttttactttcatctttagctaatatccatggagttgtttcatctatatatttgtttgctcttcttattaattcaaaaacatattctaaagcttgaggtatatttaattcgtttattgcctcctcaattttagctggtgctgataatgctaaatttattaattcatcatcaatagcttctttttcatcttgagctggcatttctccaccaaaatatttttcaaccattgcaactgttcttgataaaagattacctaaatcattacaaaggtctgaatttattttctttataaatatttcattattaaataatccatctgctccaaatggaatttcttttaataaataatatcttacaggatcaactccaaattcatttacaagaacaactggatctactacattacctttagattttgacattttcccaccatcaacaagtagccatccatgaccgaaaacttgctttggaagaggtagatctagcgccattaacattattggccaataaatagtatggaatcttaaaatatcttttcctattagatgtacatctgctggccagtatttattatataaatctttattttcttgaccatatccaagggcagtaatatagtttgataatgcatcaatccaaacatatacaacatgactttcatcaaaagttacaggtactccccagttaaagcttgttcttgaaacacaaagatcttgaagacctggtcttaagaaattatttagcatttcattttttcttgattctggttgaatgaactctggatggtcttcaatatatttgattaacttatcagcatacttgctcatcttgaagaaatatgcttcctcctttgatttttcaactggtcttccgcaatcagggcaatttccatttactaattgtgtatcagtccagaaagattcacaaggtgtgcaataccaaccttcataagaactcttatatatatctccttgatcatataatttcttaaatatatcttgaacagctttaatatgataatcatcagtagttctaatgaacttatcataacttatattcatcatgctccaaagatctttaataccagcaacaacttcatctacatgttgttttggtgtgattcccttttcttcagctattctttggatcttttgaccatgttcatctgttcctgttaagaacattacatcatagcctgttaatctcttaaatcttgctaaagcatcagcagctacagttgtataggtattacctatatgaagctttgttgatggataataaattggtgtcgtaatataatatgtttttttacaatctgcacacattatttgtgtcctccttatattaaagcaattatttattgctatttttctattataatattaatttttaccttctatatattgtgtcataacatatccagcccgcatttttcaagcatattcttcagaatattagaatattagaatattagaatatatattctaaagaatatatattgttaagattattatcatcttcatgtttttgtcttcaaattatcttggctctatcttttaatcttttcataagcacaaaaaaatctctatataagtattaaaacctatatagagacgtattatacgtgttaccactctaattcttatttacctcacagcaaataactcagtaggtgaccaacatcaccctgcaatataacggtcgcttccgtatttccctaaccaaataattttgactcaggaaacatgctctgagaccatcttcataaaattcacaaacgctaactttcagcatatattagctctcttatagaatgattcttttattactcttctcttcatagcattctatttaattaatactagtttatttaagagattattttatgcaaactttatagataaaatttttaacctataatatatattaatccccaaattatttacattatactatttgttgcttacaagtgcaataacctatttataatgtttaaattatatttccttagttgattccttaagaaattgtttttcactatcacttaagaatggacttaatttatcataagtctctttatgataattatttagccattctttttcatcctctgtcagcaattcaacattgattccacctaagtctattggacaatatgacatggtttcaaatttataaaattctccaaactcagcatttctttcgtcctcaacaactagcataatattttctgtccttattccatgtttgccttctctatatattcctggctcattagttaatatcattcccggttctaattctattgtattcggtactggccttattgtttgtggaccttcgtgaacgcttaagcagaatccaaccccatgacctgttccacatttgtaatctattccttcttcccataaaactcttctacttaaaatatctatattggaccctgtagttccttttaaaaattttgctttcataaggttgatatgtgcttttagaaccagcgtaaaatctcgtttttcttcttcagttaattttcccaaaacaatgctacgtgttatatctgtagtcccatcaaaatattgtccaccgctatcgactaacaatattccttctttttctaacttatatgcactttcttctgttgcagaataatgcatcatcgctgcatgttctttatatcctgcaattgttccaaagctttcctcaataaataaatctccttgactcctaaaatcacataacttttccgctaaggtgatctctgttatatcttccttatctagaccttctttgatccacttaataaaccttaccattgcaactccatctttaagttgacaatttttaagattttctatttccttcttattctttatggcctttaattttgtagttatatttatttcttctatcttctttattcttttattaatctgattgtatatatacgcacttattttacttgggtctaatataacactatcttgtacttcttttatatcttcaaatatatcctcataattttttattattatgccttctttagttaatgttttttcatcagcagatgatatcttttctctatctatgtatagcacagctttctcttcatcaattaatgcatatgctaaagttactggtgtatactttacatcatttcctctaatattaaaaatccatgctatatcatctaatgatgatattatatatgactttccacatagctttttcatttcatttcttacttcttgaatcttttcatttgcggtttttccgcaatactttacttcatgcaaaaaaactttttctttgggcattttaggtttattttcccatacttcttcaattaagtctttattcattactatgtttatatttttattttcttttatttttagaatttctttatattgattaaccgataatactcttccatcaaaacctaaagtttggccatccatcatattttccatcaaccactcttctaaagtcggccatccaggaattctcatcttaaaaagctctactccagaatcttttaattgttcattggcttgtataaagtatcttccatctgtccatagtattgctttttccattccgatcaatgctgttcctgctgaaccagtaaatcctgttatatatgctctagacttaaaacattcagccacatattcactttgatgaaaatcttcacttggcactatataataatctatattctcttttttcattatttctcttaatttttgtattctttctgatactctcatatttattccctcttttaaatatattttttaagaacgtcataagacctaataagtaaacacatatatgtatcttaatcttattaggttcttattttggcaacaatatattatttcatgaattcttcgatttcatcaatttccttaatcatgttcttagttaaaacttcacatccatctttagtaactaaaatatcatcttcaattcttatgcctatattttcttcagctatatatatacctggttccactgtaaataccattccttctgcaaatgtaaattctctaccaagtatacctaaatcatgagtatctaggcctaaactgtgacctattttatgccaataatatctgttaacttctgatttttcttttataagccctaatccaatacattcttgtgcaattaaatctttagcccatacatttaattctcttgaatccactccaggctttattctttcaattactgctttattaactctaagtacagcttcataaacttccttttgtctttgagtgaacttaccatttatagggaatgcccttgttatatctgcattatataaattccattgagctccaagatcaaatagaattaaatctccatcttttaactcactgttattatctacataatgaagtattgttgcatttttccctgctgctgctattgttctaaaagcataatctttaacgcctcttgttttgcattcaaaatcaaaataagcctcgatttcatattccttcattccagccttcacatttttcattaaagactttacaccttcaatagttatttctattactttcctcatttcttttatctcattctcagacttaaccattcttagaggcgcaattatacttgtaaaattctttatattaatatgtggatacttactaataatctcttttgcaaatctatttgatacagaatcactttcttcaaactcttctctatccaaatctagatacaaattaactttttcttttccctttattaatacatttaggtaggaagtaaactccttcatataagatacatcatttattccagatatctcttttccctcaaaatctcttaatgtttttccactccacatttctttatccaaatctaaatctgtcaaaaataacttttcacttactatattattatatttagataatacaaccaaatgtccgtcttcttgtattcctgttaaataataaaagttcttatctggagtaaattgatagaattcatctccagtctttttagctggtttacctgcaaataatatcattactgaattatcttctacactattcataagtttgcttctgttttctatataagtatctttattcataatttagcctcttttctactattaaaatatattcctatgttaatataatactccaatgattctaactaataaatattctgactaacaaattttatcaaataattaaacttgttattttaaaaacatatatttaccataaatatagccataattattgctgttgcatcagcaaatactgctgcccataaagtatgccttatcttttttaccttaattgctccaaaatacactgtaattgtataaaatatagtttctgtgcttcccattacaactgacgctataagacctgttcttgtatctggtcctaaactttttattatatctgtaaacacaccaattgcaccacttcctgacagtggttttattattagtaatggtattagatctttaggtaatcctattaaatttgcaagtggagcaattagattatttagtaaatccattaattttgcctctctaaatacttgcactgcaattatcatagctaaaagatatggaaatattcttaaggttaccatcaatccgtccttagcaccctctataaaccattcataaacctttcttcctttgaacataccatatgttattataagtaaaaatattattggtattatgcttttacttaagtaattaaacataattctataatcctccttgaagcatttctaattaaattctagtgttgagatttctaaaaatatttctgtaatatcttgcagcatattactccaactattgcagctgttgccgttgatgctatcgttggcaatattattattccaggattaaccgagttacatgctgctcttatagatattatcgtcgatggaactaactgtatacatgtagcatttaagacaagaaaaagcgccatatcatttgaggctgtttctttatctgaattaagtctatccatttcttccatcgcctttattccaaaaggagttgctgcatttgataatcccatcatgttagcagtaagattcataacaatagctcctaaagctttttcgtcctttgcagcctccttaaaaattcttttaagaataggctttaataactttgataatttttcggtgagtccgctattttctgcaactttcataactccacaccaaaagcacattattcctgtaagttcaattataaaagttacagtattacctgacgaattaattattgctttggaaataagctctccatttccagtcaataatccaactagaattccaaaaaatattagaaaaaaccaaatataatttatcatattctccccatagtatagttattctttacatttatattccttgcacttattttttagtagtgataggatataattactaaacataattatattattttaaggagaatttttatgaacgattcaaatttaaagatagctcaacaagatgtagaagaagctctaaagactgtagaagacatggaaaaagttataagcaatgatgaaccgtcaaaagaacaattaaaagaaaagtttatttgtttatcgaatagagttcaaaaattagaagatattttgaaaaacgaaggaatcctttaaataaaataggtatgtctcaatatattaagaactatattgaggcatacctattcttttaattttctaaaataactttttgttcctttccatttcccattaaatcctttgatgtcttaacaaatacgatgagtgtaattataactgatagtatatcagatgttgctcctgcgatccatactccatctaatcctttgaaccttggaattattataagacatggaattagtattatcacctgtctcaataagcttaaaaacatcgatatttttactcttcctattgattgaaagaaattcgtaattataatttgtgctcctataaatggcagcataattaaaaatattctcattccatgagcagttacttctataagcgatgattcattattaaaaatcttaactaatgtttctggaattccctcaattattataaatcctattaccactattattgtagctataataaccccgtattttaccgcttgcttaactctatcatattttctagcgccaaaattataaccgattataggctgaagtccctgatttaatccaaatataggcattagaaatatcatagctaagctgttcactatagtcattgctcctacggctaaatcaccaccatatgactgcaatgaattattagttatcacttgaactgcactttgtgcaagctgcatgctaaatggactgacccctatagcaaaaatacttaaaactgcgtccttctccaattttaaatttttccttcttatcttaagtacactagatccctttgtgaaataatataaaatccatatactgcttattgtctgcgcaacaacagttccaagggctcctcctttaactccaaggcctaaaccgaatataaatattggatctaagatgatgtttataatagcactcattagcatagacgccattgctatttttgggcttccatcgcttctaattgaatgattcaaaccgaaactcatcaaattaaatatgcaaccgctaataattacccttataaaatcttcaccataacctataatattttcactcgctccaaatgctttcaaaagcggattagcaaatatatgaccaaacaacgttaacaatacaccaattattattattaatgtaaacgcatttcctagaagcctttctgccccttccttatcatgctctccaagctttattgacacttttgtagctgtacctattccgattaacataccaaatgctaaaattataaacattattggcattgtaattccaacaccagccatggcgagttcacctatgccttctatatgcccaataaatattctatctattatgttatataatgtattaactaacattcctataattgcagggattgaaaactcaagcaacaattttcctacacccatttctcctaatctattctgcttattcatgaatatcctccttattaattaaagaactcttagataacttattcaacaaattcattaattcttgagattcctcatcagtaaaacacattctaatctcagattcccattcattcattatagaatatacatcatctttaatttgttctgctttctcagttagttccaatctatatgcacgcttatcactttctttttttattctccttacataaccttcatcctctaatttctttattgccctagctgttgtcgccttatctaatctaacctttttcgtcaattcttcttgtgttataccatcattttcataaagatttaaaagaaataagtactgaccagcccctatcccaaatttactaaatctcttgccaaaatacatatagctagatctatgtatttcaccaatatacttacctatatgctgatagcaacccatattacttctcccctatcttaatcatattaatatagtattaacaataatcatatttcatatccaaataattacatacaaactatattagcataaattagttacgtgcgcaactaattataactttaacgctaatagaggactactcccaaatagctctaaactatcttgaagtagtcctctataaacatatacatttaatatttatactaactaagtataaaatttgattatttttctattaaactgtactttctctttcaactagctgatgctctaaaacataatgtggctcatctagctctttcttatttaaaagttttataagcattctcatagcaacagatcccatatcataagttggttgagaaattgttgtgatctttggatagaaaattgaagctgcaaaattatcattaaatccaattacacttacatcttttggaatatctaagttattatctcgtagtgcattaattgctcccattgcaatatcatcagaagcacatacaacacctctaaatttcttattttgctttatgaacttttgtatgccctcgtatccactctttactttcattgagcttagatgaactagttcaggatctatttctattcctgattccttcattgcattttcataaccaacgtatctatcaccccaagcatttttgctctctttttcagctcctataaaggcaatttcttttattcccttttcaattaataactttgtactatcatagctagctttaacattatcaattgttacacttggtagaactccttctttatccttagtttcaactaaaacagtttttatatctaattcattgattagttctaatatttcttcattaagagaactactcatataaattacaccatcaaccattttttctctaagtacccttaagtattctttttccttttctatatcaaggtctgaattacaaagtattatattgtaatcgtatatatttgaaacatcttcagcacctcttacaatttctgggtaaaactggtttgatatatcaggaagtaaaattcctattgtctttgttctttgagtttttaaacttcttgcaactatatttggtctgtatccaagcttttttattgcatctaaaactttcttcttagtatcttcgtttactacatcgatatcatttaaaactctagaaacggttgcaattgatactcctgcttcttttgcaacatccttaatagaagtagccattattattcctcctttgaatttttctagataatctcattatactaacatattgccttataaatcaacataacttaaaataaattattattttattgtaagttttgtcaaaaatcatagtttttaatcttaaatttataaacatattaactaatttacaatcttatataagaaatatatatgaaaaccatattaaatatgtatacaaatattaaaatgactaggaatattaataaaatcttttattcctagtcattttagtttttatcttacaacttcaacattcatgtttaatgtttcactatttataactgtttctgaataattagattcttgattataaagaacttcacaagttaaagtctctttctttattgtttgttcgaatttcttaataacatcaattaacatatcgttatttgatacataaagatttattctatcagcaacttcaaatcctttatcttttctcatattttgaatctttgaaataacttctcttacatgcccttcctcttgaagttctggtgttacagttgtatctaaaacaactccaagttcaccttctcctgcgaatgcataaccttctaaaccttgcattgtaactaaaagattctcatttgtaagaactatttctgtatcattaacaattatagtttcacttccaccattttgaatcttttgagctaattccatttggttcttttcagaaattgcctttctgatttgaggaattaattttccatataacttacctataacaggtagattaggttttatttcaaagttaacatattttgaaaggtctgctccaagatcaacctttttaatatttaattcttcttttacaatatctccataataatctggaagagattttgttgatataagtaattcagaaagtggctgtctattcttaacatttgcagcatttctagcacttcttccaagcttaacaagtgtatatgctaaatccatctctttttctaattctttatttattgcagatttatcaacttctggccaagtgcataggtgaatactttctggcgcatttttatcaagattcacaactaaattttgatagatttcttcagtcataaatggtacaaatggtgatgccaccttaactaaatttgttagaactttatataaagttacataagctcctatcttatcgtttgttaactcttgtgaccaatatcttgatctgtttcttcttacataccagtttgataattcatcagtaaaatcttcaatagctaatgctgcttgagttattttataagtatttaatccatcatcaactgtttcgattaatgtgtttaatttagatataatccatttatccattatattatctgaaacaaaatcagagtacttagttgaatcaaatttatctatttcagcatataaaacatagaaagaataaacattccataatgttcctaagaactttctttgagcttctgcaacatcatcaatagagaatcttgttggaagccatggtgcacttgcagtatagaaatgccatcttgtagcatctgccccttgactatttaatacttcaaaaggatctacaacatttcctttatgcttagacatcttaagtccctttttatctaaaacgtgacctaatactatacaattttcaaatgaatttgtgtcaaataaacatgttgaaattgcaagtaatgtatagaaccaacctcttgtttggtcaactgcttctgaaataaattgtgctgggaagttcttttcaaaagtttccttgttttcaaatggatagtgccattgtgcaaaaggcattgatcctgagtcaaaccagcagtctataacttcatgtgttctcttcatttccttaccgcaatgtggacattttaactttattccatctacgtaaggtttatgtaattcaatccccttacagtctgtagttgctttttcttctagttcttctctgctaccaatacactcttgatgatcacattcacattgccatattggaagtggtgttccccaatatctgtctcttgaaataccccagtcaataacattttcaaggaacttacccattcttcctgttctagtgttatcaggataccaatttattttattattattttcaagtaatttatctctcattttagtcatcgcaacaaaccaactatcttttggatagtatagaagcggtgtatcacatctccagcaatgtggatatgagtgagtgtgcttttgtgctgtaaataattgattacgttcttctaaatatttaacaatactttcatcacacttcttaacaaactttcctgcccatggagtaacttcttcaacaaaattaccatttgtatctactaaatttataaatgcaattccatttttctttgaaacaagactatcatcttcaccataagctggtgcaatgtgtactattcctgtaccgtctgataatgttacataatctccatgaattactacgaaagcttttccttcaacttttgcaaaaggtaataattgttcgtattcagtacctagcaattcttcacctttaaactctttaactatttcgtattcagtatctcctaacaccttacctactaaatctttagctaaaatataaatttcttctcctacctttacttctgcatatgtataagatttatttatacataatgctaagttagatggtaatgtccatggagttgttgtccatgctaatatatatttattttcttcacctttaactttaaactttacagttgcagttaaatctttaacgtccttatatccttgagcaacttcatgagatgaaagcgctgttccacaccttgggcagtaaggcattactttgtggcccttatacaataagcccttattccacatttgctttaaagcccaccattcagactcaatataattatcatggtatgttacatatggatcatccatatcaacccagaatccaatttgttcagacatttccttccataagctaacatatgagaatacgctatctttacattcatgaacaaacttttctacaccaaagtcttctatttgttcttttcctgagattccaagtttcttttctatttctaactctaccggaagtccatgagtatcccatccagctttcctaagaaccttataccctttcattactttatatcttggaattatatccttcataactcttgtcaaaatatgcccaacatgtggctttccatttgctgttggtggaccgtcataaaaagtaaaatattctccatctgaatttgagtcaaagctcttctttattatgtctttctctgtccaaagctttgctatgtctttttcaattttgacggtaccttttgatgaatctaccttattgtacattaaaaattcccctttcagctaagtaaactatattattctctttaagaattgtttcctttttgcatacttttttaaacataaaaaaactccatcctaaaggacgaagttgaattcgcaaaccacctaaggctaaaacatctaaacgcaaaattaaatgttttatttcaagtacatacatactctatcctttaacgcaggctcttacgtgataacttattcggcattacgcctttcagcctccaactcctaggtgattttctctaagatttattatagctttacaccaaccaactactctctaaaaataatatctaagatacttttcctaatcatcgtcttttattgtaataattatatattaatgatttttaaatgtcaattcatgatcaaacactaattgtatctttattactaatttatgtcataaaataatttaatcctaattttataaggttagcgtgatatcatcttaacaattttacagcttaactaagatataaaattaaatattatcatgaatataactacatatttactcataagttgtattattaacaatactataaatagtatcttcttaaagggggaaatatatgttttgtaagaattgcggacaacaaatagatgataacgctgccgtatgtatacattgtggtgttgctactggcaataatatgtcttctaaaagtaatttagacaatccatctcatttagccggaattgcgtcttgttgctttccagtagtaggaataatattgtacttcttatggaaagatgaaaagcctcaaagtgccagcctagtatgtaaatggatgattggtggaataattatctggataattttttacgttctagcttttgtactcggaatgctaggcagcttatcatcatactaagttaaatgcttaattgtaaaaaagtcttaaactatatgtttttctgccatcaattacctgagagatcattcttttttagaggtcatcaatttccattatgtgcaagatgcacgggaatattactgggatatatcctcggactcacatacgtaatattatctaaaaatattcatataattatagaattattactgatgctaccacttttaattgatggatttggtcaatatctcatgtactttaaaagtactaatacaaggagattaatcaccggaatcttagcaggcatatcaactatatgtttatttagattggcaatagttttaggtcttcaatctggacattggttttataattttattcatatataactgtactgatttcttactacagttataataatactaatataaaacatagctatctaaatctagtattcttaatgatttagatagctttacatttttgaataaaatagctatgtagaccctttagcaaataaaataacctttcctagtattatcttatttaattattttaggaattaataatataaattcagatccaacgccatattctgaattcacttttaacttaataccaaaattctttgagatagattttaataaactaaggcctattcccgttccattaatattttgtcctctaactatatcgcttcgataaaatctatcaaatattcgtttttcttcgtccttcttaattcctattccattatctacaaccattatcctaatatgcttatttacatcctcaataacaagatttattttaccatcttcacctgtatatttaaatgcattttcgatcaatattataattgctctctttatcttatcataatcccactgaactgatatttcttcttctggcttagcaactttaaatattttctccttaatttctgctaaatcaaaataaaattcgcttatatcattaattaaatcatctaatttaaattttgttatatttatagacaagtctagatcttctttagataataataacaaatcgctattcaatttctctagcccccttacttcactcatcatctttgaaatatgctcaaaatgattatctatagtatctccccaagagtgggctaatagttctaacttaccctttattacagctaacggtgttctcatttcatgagaggcatcttgaacaaaataaacttgcttttcataagcttccctaactggccttattacttttgttgaaagataagctgaaagaattattgcaattataattagtattataagacttactgctatcgaatatctcaatctatttatagaatttacttctgaatcaatattcgcaataacttgtatcttatactccccactactaatagcaatttctctaaagttatagccattatttattatcgtaaccacttcgttttccgcatcatttgaaattgttggcagattatctttactgaaatataaatttctactcattgtttcaaactcattatttttatacacaataacaataagatttggaggtatacgcttaggctttgaatctaattttccatcaaaattctctggtctatgtggattttctcctccatctggatttttaaattcatctttatgtaaatctccatctaaattatgcctatcttcattaaaaatatattcatagtaatttggattaaattgttccttagttaaaatctctttctgctctaaaagctgatgatctataacatctagtactctagacgaatataatacctgcgttattattgcaaatactattaaacacccaaaaactataattgtactcgttgctatgattttcttctttgtagataaaaatatatctttcttcatgcattaatcctctatactttcatccaacaaatatcccattcctcttttagttataagatactttccatatccaaaagttcccaattgctttcttaatctgcttatataaacctcaattatttctgttgctgcatcactattatatccgcatacattatcaaatatttgttccttaaatagcaatacacctttatttataaccatatactccaataacttatatagcttttcatttaactccaattcatttgtacctatatatacttttttcactttcatatcaattttcatatctttgaactcaagaagattagcccttttaactttacccatgctcttcaaaatcgaattaatccgtgctttcaactcctccataaaaaatggtttagttagataatcatttgctcctaaattaaaagctttaagcttatcaccaagttcttcttttgctgttagtataatcacacctgtatttaaacaatttttagatatatggctcaaaacactcattccgcttacttctggcaacataagatctaatataacaatatcatagttataaatgcttaaacattccattgcatctgatccattatacaccgctttgatttctaactcatctctaaaatattcaactatattttgacttatttctatattatcctccacaagtaacacttttatcattattctcactccaaaccaaatatttaaaataaagttcctataattaattttttaaactctgcctaattatatactagttttcttaacactcgcttaatttatttaagacgatattaatataataataaaaattattatttaatataggatattttttataattattgttataatattaattaactatacttttattttagattataaaatgtataattaagataaagttagtttttcaattaactttaaaaatgtttttaggagatactattatggaaaataatttgaatgaagcaattttagataaattaacaaaaacttgtacttgtaaggcaatacctagatcaaaaattaaggaagctattaaaaatggcgcttcaactataaaagaagttcaaaaggctactggagcaggtagcggttcatgcggaggtagaaattgttctccgcgaataaatgatttactgaagcaatcaagagaaaacatataatcattaaacttttactcatagtaaattaaaaaagcaaaacacatacagattaaataaatcatgtatgtgttttacttttaattataatcttaaacagtttttcattcacaagttatttttccatccttatattctggaactatatctatgatgcttttttttatgcaataatcaatatcattatttaatcctaaggatttcattactgaatagtgagatgcttctcgtacatagcttaagatatttatattttctttatatatcatacaggctgtctttgctatatctgttaactctatatttctattaacatctagaattcggttaattatatatccactacaaataaaatcatccatcgagaagtttccatttgttcctgcattaataataaccacatcatcatttatattaatcaattttttcgccactgattctccatttatcatagcccctataaaaactcttttcgcctccattgactttgttaaagctcttgttccatttgttgtagtcataagtactgttttatcttcaactttttcttttatatattctaatggcgaatttgatagatcaaaaccttcaattttaacagcttttctctctcctcctaaaatataattatctctactaagtttctttgcatattccagtgtttcctcaatagtcaaataaggaataacttctcttgccccattatctagtgctgttataattacagatgtagctctaaatatatcaattataactgcaatcttattccttactctgctttcaactatatcatctgctgagattataatatctattttcattttacctactccatttccaatcattagaattaatatatagttactccctgaaattttttccttgccataagttgttatcttctaacgtcttatctattgaatttaaaacttcccatttttttaaactccacattggtccgatcaagagatctcttggtgcatcgcctgttaacctgtgaactaccatatcctttggaagtagtgttattccatgagtcacaagatctatataatcatcttgcgataggaacttaagatctcctgcctcgtataactttaccataggtgtttgcttcattaaatgtagtagatgcagtttgattcctttagcccctgaatgagctatataatttattgtttctaacatatcctctttagtttcacccggtaatcctaaaatatcatgaactactacatcaatatttctctcttctaattttctcattgcattttcaaatacatctaatttatatcctctattaattcttttagcggtatcatcattgctggtttgaagtccaagttctatccaaagataaatcttattgtttatgttatccaataattctaatacatcatcatctaaacaatcaggtcttgtagctattgcaatggctacaactccctcctgatttaatgcctcttcatattttctcttcaactcatcaataggtgcataagtgtttgtgtaagcctgaaaataagctatatacttaccacttttccacttttgtgacatcatatcctttatgtcatgaaattgctttgaaatagacaattctctgtcaccggcataatctcctgaacctctttcactacaaaaaagacagcccccattacttatctttccatctctattcggacaagaaaatcctccatccaaagatattttaaatactttttcaccaaatttattccttaaaaaatagtttaaactatgatatctttttccatcccaaaaactgttcatatttcctcctctttatgtgtctaatataccttctttaaatattgtaacatttaaagaataaattaaaagtaaaccttatatatttaataaaaggaacattctttaaggggataaatattgaaaaaggaaatggtaaaagtatttcaagttgccactgtgtttatcggaacaatagttggtgctggtcttgcttctggaaaagaaatcacagaattttttactcaatacggtatatctagtttcataggaattataggttgtggtattttctatatcttaataagttctataatttctagaataagtattaattataatcttagctcttatagtgatgttatgaatataataagccctaatatatttggtaagatcactggttttataacaactctctttcttatttccagcgcatctataatacttgctggaagtggtgctttgatacatcagttttttggaatacccaagataattggctcactaataatgattgcaatagccatattttttctacttagagatactgaaggattaattgaagttaattcctttattgttccaggtttaatttgtactcttactctgattacagttttatattttgcattttgtagaaatacagtttcgttagataatatcgctagctttccaaaacaaaaaactggaatctttatttccacagtactttatgccggatataatacactttcagcctcaggagtcctagtaccacttagcactcaaatgaagaaaagtaaaataatgattgctggaatagtaaccggcgcaattggactaactatactttgtttaatgataaatttattattaacaattaatcaaccttatatatataaatatgagattcctttactttttgtcgctaatagatttggtaacttaattcaagcattgttactcgtgataatctggttggagatgttttctactgaagtttctgacatatattccataagcaaaaccctagagcaaacatttaatataaaatttaaaaaagcaatctttatcgtaataagtcttgctcttttaatttcccaatttggatttggaactcttataactaaactatatcctatatttgggctattaagtttgatttttatattccaatgtatactattcttttttaagcataaaaaagatttttctaacacgactcaaatcaaataattatgatatactttttataaaatatattaataattattcttaaaggatttgatataaatgaattatctagatttattaaatgaatgtactttatgtaatagagattgtaaagtaaatagaaataatggtgaaataggatattgcaaagctagcaataacataaaagtggctaaggcttcccttcatctttgggaagagccacctatttcacaaggaaatggttctggtactgtatttttttctcactgtaatttaaaatgcgtattttgccaaaactataatataagtcagggattagtgttaatttatcttcttctgattttaataaaaatagtattaaaaacacatcagttgttggtgcagaaatatctatcgaaagactttccgaaatttttctagaacttcagaaaaaaggtgcaaacaacattaacttagtgactcctacccattatgttcctcaaataattgaagcattaaaaatagctaaaaaaaataatttaactatcccaattctttataatacaaatagttatgattccattgaaactataaaattattggatgggtacatcgatgtttatttgccagacttcaaatattttgataataaatattctctaaaatattctagagttaatgattatgcttccaataccattaaaataatagatgaaatgctaagacaagttggcactcctaaatttgattcaaaaggaaatatactaaatggagttattgtaagacacctaatgcttcctggactcctttttgattcaaaaaagataatagatattctatataatagatataaaaatgatatttatataagcttaatgaatcaatatattcctatgttcaatgcttgcgattatccagaaataaataagaaacttaatccaaaacactacgatagcctaatcaattatgctttagatatcggcgtagttaatgggtttatacaagatgaaggtgctaacatatctgatttcattcctgaatttaatctagaaggaatagaaaaataaatttttatcatacatatatcttctaataatttcattaattatagcagctcctattctaatcgtagctatataatatagctgacagagaaaatgggaactgcttctacctctaaaaaccatcttaatataattctaataataaaatttaggaattcctcttttattatctaaacctggtataatcggaggtataaattcattcattccaagcgagcttcttaacattgaagaatctctaagttcagctatccttgatacgccaacatagatgtccgatattctataccatgttgcataatcaacaattccggtttgtggtaatgtaaatatttgttgaaatgttttaactgcatctgctgtcttttgattaaactgtccatcctcagcaaccttaggtatcaaaggataatttctagctattctattcaattgattctggatagttcttactgctggacctgaagatcctatagtaagcggttcaccagggtatgactgtgggcttccagaaactttttcagctgtagttagttctatatcatttccataataatttttcaaaatatcatatggaaccattccttgttgagctaattgctgacttccccattggcttaaccactgagggcaggtaacactctttccatcacaatattgtgtcaaaagtggttgtttagctccaactctctttatataagtagaaaatatttcatctacaatagcacttatactatcgtaaatatttcttccataattaaatgcgtgatcataagctgttgaactggtaatatcaaaattctttccttttcctctgtaccattcagtataaattctatttagcgtaaatgatacaatgcagaatacatttgctcttatagcagattcattccaagttgaatatatttcgctggaagcaacatttttaatatagtctttaaaaggtactttataatttggtgctgatggatcattgggcccaccttggtgtacaataatatattctggaactattggttgaggcaatacaactccagaacttggtgggggtaactgcttttctggatcctctggtattttaggtgggaaatttccattcaaggtatttggttgtatatttataacctcttgtctcatcattccccttcctgagttacttgtcaaattacaaatctgataggcaacctgtgtaggaaatacttgacatcctcttattactattgggttaaatccatctctttcaaccgttatatcatataaactataaggcacttggttgctattaggattcaaagaatattctaaaggtggcgctgtcaattcaattatttgtgtcaatccaactgaatctgtaactagctgaatactattaacactttcagcgccttgtggtgttcttacagttattctggctccatcaattggaatataatcctcccccctgaaacattgaatctttaacctaccgatatttgttgaggtatttccactactcgtattctccataacttccctctttatattttttctcaaaatattatatttattaggtacgctatttgttacctgtatatctcttgaatttatatttcctctagtcaaaatagcatttaaatcattttgtaacgctcttaaactgttgaatatacatacttcaccatatccccatgagggatttggatatgttacatctgtacgtcttcttctcgctcctcttaataaataatattttaacctttgaccaaacaaatatggatcatttcctttaactattccccattgcatcattaacgcacatattccagatacttgaggagtagccattgatgtacctgttttattatcgtatccaccatttggtactggccctgcaatatcctctcctggagctactaaatcaggtcttactatattctgatcttgtgcacctcttccactgaatgatgataaattattggttctataattataacttcctacagctattatattatctactgttgctggtatgcccagcgtattatattgattaggttctaaaaatttagttgcaggatttaatccttctaaaactggaagccatattgaatatgctcctaagtattcattcgtaacatttatttctaatgtccatacaccttcaacaagaaagccagatctagcagaaagaattattctgatttcactattcaattcaaaaggtttaggtccagatacatatatatcgtatctatcactccctattgttccttgaatgtaaccttcttgtatattaatatttccagttccttggcttgttggatttattatattaactgatatattaggtaatattgtcttataaaaattcattactattgatttttcttcgcttgctatattaaaaatttgcctttgtgttttaactaattgtccgccaacatgatgacctgcatcaccttcatttcctgccgcaataacaatagatactctttccaagttagatatcgtcctaatgtattgctctaataagctgcttccatcgtgtgctccatcattagtgctaagactaatactaataactagcggcatattcagttctttacctttatctataagaaatttgattccctgcataatctgagagcttaagattgcagttcccctagcagctttaaccattgctatagaggaattaggagctacacctctatacataggatttattcttcccccaccacatgcgattcctgcaacgtgagttccatgtccactattgtctattgatggaactactgagaagggattattggattttattgcttcatttatcatttgcttattatatacatttccccctgtacttaaatcataaatgtattctattctagtggatgttccggtcgaatccataaaagcagggtgagtataatctatccctgaatctacaaatccgactaatatcccttcacctgaaacatcaaaatctggagccaattgaagtatacaggatgccctattactttcttggtcttgctcatataagttctttggtaattctatatattgaatagaattactcattgatagctgttctaatttatctctgggtatattaacaacagcaaagttaaatcctaaatcctgaaaagttcctcctaatccttcaacaaatgattttgtttgttcttgagtatctctatataaaatagtgagctccacattgttaccctgactctgatacttataacctagttcatctaatatagcttttggaacattagctaataatcctattgatgcatctacctttgaagatatttgtgtctccaattcaggcataattaccacaccttaattaaatatattcatagatatactatgcaattaaatgttttaatgtaacaaaaacagagaataactgaaaaattcaattattctctgtttctacctacgctttaatttttcaatataagagttcttacattagttgcttataatgtaatctctagtctttctaatttagcaattacatctacttcttttaattccatggtttcagtaagaagacttccagcattgcttactaaaagtaatttagaattacctaatacctttatttgtcttactttcctttttcccttataatctattaagaaaaatccgctattacttatatccttcacagcatgtgcaaatgcaacatcaccctttagcattctaaatccattcatttcatcatcttcaatttctaaataaaatactttatcttgaggataattctcgattttatttgaatgaataggcatctctttagaaccctttttattagatagtgaataatcatatattggaacacttctaagtactgatgagaaagcatcagtccaaacttctgaactttctacatttcttttaggaatttcctttaaagtttttctttcttccatcaatacttcatcggtaacaaccatgcttatgtcatttaaatcagcttttaataccttgcccgctttatctattagtgattcaggtgcaacttttcttcccatttcaacttcatttaaatatttttctgctacacctagttttttagctaaagctttaaccgtaagtccgctcttttctctagcttgttttatattttctcctacacgactcactttactttctccccttttgttgttctttataccattctctttcttcaattaagtgctctaatagatatttaaaagtccacttgtaattctgtgctgtagatacagcaagtactccaccttgaataaagcttctaatatatctaatagtaactttcaattgttcatccttaaatccattgaaaattagtgccttttcactcaactgcatttcatcgtaagaatcttcatttttgtttccattaattatatcttctaatgtcattaaagtcatattcttattaatttctataactttaatattttgactctcaattttcttaatttcatcctcttttaatccatacgctaatatacatttattatttgtagccatccatgacacctctcttctttttacttactatagtcttgtagaatggtattttttactcttcaattattttaggctcttttatttcttccccttgcatatctactgtaacactttttattacttgatcttcataaggcctatctgacatatcagttttttgtgcaacaatcttatcggctacttccattccttcaataaccttaccaaatgatgcatactggccatctaaatgtggagcatcagctaccataatgaaaaattggcttcctgctgaatctggatgcatagctctagccattgataatactcctcttgtatgttttaaagtattcttaaaaccattgcctgtaaactctccctttattgaatatcctgggccaccaacacctgttccttctgggcatcccccttgaatcatgaaatttggaataactctatgaaatattagaccatcataaaatcctctattgattaagtctacaaaatttctcactgtatttggtgctgcctcaggatataattctgcttttataactccaccattttccatagtcattgtaataattggattcttcatctttaaatattctcctctcgatatcaatcttaattagtattattatctaaaatataaatttaaattcatccttatattatatatttcaataaatctgaatcatatttatattttaaaattaattaaactataacaaaaatctatcactttatcatcatttattgaattacaaatttctatattccccttttctttagaatcatttagtaaaccactttcaattaacttcctcttcaattcttgagcagtaccaaatccaccatcaataagaggtatttcctttccaataacgtttgataaagccttttttataaatggataatgagtacatccaagaactatggagcttatatcattatctaagtaacctttgaacttttcctttaagtaatactctagatcttcgccctctactattccctgttctataaattctactagccctgcacatggtaatgatattatatcagcctcatttttatatttatccattaataatttaaatttcttttccctcaatgtcataggcgttgccattattattatttgaccttttctatttaacttaacagctggctttaatgctggctctattcctattatagatatctgtttatatttacttctaatctcttctattgctgcactagttgcagtgttgcaggctatcacaactgctttaacatttttacttagtaaaaactccacagcatcaattgtaagatctcttacctcaattactttcttaattccatagggtgcattctttgaatctccgaaatatataaagttttcattaggcatgatagatattgcttctctcatcacgcttaaacctcctacccctgaatcaaaaaatcctatggggtcagtttttatattcaaaacatcctcactccattttttcaaatatttaggtctgcgcaaataactaatcagatatatgaaaccacatttcacatctaaaaataattttggttgaatcttaagtattaactaatatttaaaattacaatataaaaaattgaacataaatccgatttattattctttaatatattttatctacaaatattttattactttatttatccaatgtctataatttatggttttcatctactcatgtggataattaaatgaattataaaatattaacttacataacatttttattacataattaaatataattttatcaaaaaaaactatatcattcaaaataaacatctttttatataaaaattttttatatatatgagaattttagatattattttaatatttttgcattatcattgtataaatttacatgttatttatgatataatgattattattaatttggtgaggtataatcatgcgattaattccaattgaatgtgtaagagaaaattcattgctaggcaaagacatatatacccctgatggtagatgtctacttagagctggtattctgttaaacgatactatgttacaaaaaattaaggaatataaaatattctctttatatataattgatgactatagttctgctgaaattgaagatgttataaagccagagttaaggcaaaaatctatatctgtaattaaagaaacattctctgatatagaaagaatagcttctgttcataaatttgaaaagagaagtattagtgagtatacaaagcaggaacaacaatatttcaattcaattactaatatagcagaagagttattagataatgttttatcaaataaaaatatactgatttctttagttgatataaagagcatggataattatacttatgctcattgtgtaaatgttgctgtaatatcacttatacttggaatcagcttaaatttatctaagcgcaatctaacttatctctgcattggtgcgctaattcatgatataggaaaatcatttattccaagtgaaattcttcaaaagccaggtaaattaacacctgaagaatttgaagtaataaaaaatcattctctatatggatataaatttttgaataacttttttagcttaagctctcatattaagcttatagttctgcaacatcatgagagatttgatggactaggttaccctaatagtatatctggtaataaaattagctatctcgctagaattgtaagtattgcagatgtttatgatgcattaacttctgacaggccttataaaagagctatgtgtcctagtgatgcactcgaatacttaatgtcaaatgccggaacactctttgatcatgatatgcttaacgtattctgtaaaattgttatcccattccctcagggaacaattgtaagccttagcaatggtgatgtaggagtagttgaagagactatgcctaactttccattaagaccaactataaaaatacttaaaagcgattatcctaataaaattggttctaaagtcaatttaatagaaaatctttcaattgtcatttctgatataaaatatgaaatataaaataagctactaaattataaaatttttgtagcttattttttatatattctttaatttttcactagttaatgaatgaaagtttagatatatagtatgaaaattcatctagattttatgtactttaatttatgcttcttctatttagaaatggattcaaatttgctaatgcttcagcttctttaaaacttttagctctaaaaactaacgtccaaccatttttatcatactttccagcacacattatgtatttttcttgttgttttatgtaattaccctgtttatctataattaagcttctaatattatcaatgcttttacagtttaacttaacaaaaaaatttcccaattcgttcataatacacatctccttagcaaacatatgttcattaattgtattatacagaacatatgttcacttgtcaatatttccttttaataatatatttcatgaaaaaaactaggatatcatctgtcatatcctagttttaatttttaaataagtgcagtaacttgagtagtctttttaatactgctttaactcattaatttttattttgctatattgaatacttccaaatccttattctcatcaaacttctcaagttccacatctgcaattgctcttaatgtatctaatgctgtaatcactcctaagtttctctcaactgctgctcttcttattaagaaaccatctcttttcgaatcatttccttttgttggagtatttacaactaagtctacttctctgtttttaactatatctaaaatatttggttcttcttcatctatctttcttatttcttctacttctatacctgcttccttcaataaagcgcaagttcctgatgttgcaataaatttgtatcctactgatgctagatcttttgctattggtaggaattctgccttatcatgcttatttattgtagcaagtatttttcctttttcctttgaaggatacatatacgctccaacaaatcctttgtaaagtgcttcctttatgtttctaccaactcctaaaacttctcctgttgatctcatttcaggtcctaagcttacttcaacattaggtaacttttgagttgagaatactggaactttaactgaaactagttcaggttccttatatacatctattccatatcccaattcctttaatttagcgccaagcattacttgtgtagctaaatctactattggaactccacttaccttgcttatatatggtactgttcttgatgcccttggattaacttcaattacatataattctccttcaaattctatgaattgaatatttatcataccctttatcccaattgctaatgctaattttttagtatactctaatacatctgctttaattttgtcagatatattttggcttggatacatagttacactatcccctgaatgaactccagctctttctaagtgttccatgatacccggtattaaaatattctctccatctgatatggcatctacttctatttctctacccattagatatttatctataagtattggatttttactgtctttagcgaaagcattttctaagtagtatgttaactcttcttcgtcatgagttatttccattccttgaccaccaattacatatgaaggtctaacaagtactgggaactttaatctcttagcttcttctaatccttcttccaaagaccatattcctttaccttttggtcttgatattcctaatctttctagtaattcatcaaacttttctctatcttcagccatatctatttgatctgctgtagttccaagcgttacaatattttgttcctttaagaagtttgcaagcttaatagctgtttgaccaccaaattgaagtattacaccatctggtttttctttttctattatatttaaaacatcttcttctgttaatggctcaaaatataacttatctgatacatcaaaatcagtacttactgtttctgggttgttattaactataatagtttcaattccaagtttctttagtgcttttacgcaatgtactgaagcgtagtcaaattcaataccttgccctattcttattggacctgaacctataactataacttttttattatttgatacttctacttcatcatattgctcataagttgagtaatagtatggagataatgcttcaaattctcctccacaagtatcaaccattttatatgaaggctttatactccatatgtctcttaatctatatacatcgtctggactaacctttagcatatcagctatagctttatcagaaaatccttttttctttaaatgatgtaaccattccttatctaaatcttctattttacttaattttaatctttgttcttcttcaactatccactttattttttctaagaaaaacatatcgattccagtaattttatttattctatctatcatgtaatctcttcttatcatctcagctaatgcaaagattctttcatcatcaggcttcattactatgctctttaattttgaaatactatattctttaaatttattatgatctaatgaatattttcctatttctaagcttctaattccttttaaaaacgcttgctcaaaattggctccaatagccataatttctccagttgccatcatttttgttccaagttctctgtcagcaccaaagaatttatcgaaaggccattttggtatttttactacaacataatcaagtgttggttcgaaacacgcatatgttttttgtgtaacagcattttttatttcgtctaatccatatccaagagctattttagcagcaagttttgcaatgggatatcctgttgcttttgatgctagtgctgaacttcttgaaactctcggatttatttctataactgcatattcaaaactatttggatttagtgagaactgtacattacatccaccttcaattccaactgcatttattatatttattgatgctgttctaagcatttgatattctttatctgaaagagtttgtgatggagctacaactatactatctccagtgtgtataccaacaggatctatattttccatgttacatacagtaatacagtttccataagagtctctcattacttcgtactctacttctttccaccccttaacgctcttttcaagtagaacttgaccaattgtgcttagttgaagtcccgattctaatatggttctaagttgttcctcgtcatcagcgataccaccgccagatcctcctaatgtataagctggtctaactataactggataaccaatcttattagcgaactccaaacctgcagttaagtcagttacaatttcactctttataactggttctccaatcctattcatcatatctctaaataactctctatcttcaccttctttaattgatgcaatagaggttccgattacttttacattgtatttttctaatataccagaatcatgtaattctactgcaaggttaagtcctgtttgaccacccattcctgcaagtaagctgtctggtctttccttagctattactttttcaacaaattctaatgttaatggctctaaataaactttatctgcaacttctttatcagtcattattgttgcagggtttgaatttacaagtacaacttctataccttctgattttaatgcttcacaagcttgagttccagagtaatcgaactctgctgcttgacctatgactatcggacctgatcctataactaaaactttttttatatctttatttaatggcattttactaaaacctcctatagtgcatattctaagaacttatcaaatatatattcactgtcttttggacctgctgatgcttctggatgaaattgaactgagtatattggtaaagtcttatgtttcattccttctacagttccatcatttatattaacgtgagtaacttccatgtcatctggtaacttctctactacatacccatgattttgcgaagttatatgcacaatattagcttctaaatctttaacaggatggttgcatcccctatgtccaaacttcaatttagtagttttaccacctaacgctaatcccaataattgatgccctaagcaaatacctgttattggtttctttccaactaattttttaatattttctatggcaaaatctaaatcttctggatccccaggtccattagataaaaatattaagtccgggttaatatttaaaacttcttctgctgttgctgttgctgggaatatagttaatttgcagcctctctttttgaaattccttattatattagtctttataccgaaatccataaccgcaatatgttttcctgttccttcaaccacataaaacttacttgttgtaacagtctttacagcttccttagtagaaaatcctgctattttttctttcacatattcatcgtcaacatcttctagtgctataaggcctctcatagtaccactatttcttaaaaccttagttaaagctcttgtatctattccttccaagccaataacttttccttgttttaaaaaatcttcaagttctaattcacatctaaagttacttggcatattacatttttctctaacaataaacccccttacttttattgaatcagactccatatcttcaaggtttatcccataattccctattaaagggtaagtcatcgttactatttgtccgtaataagatggatcagtaagtacttcttgataacctgtcattccagttgtaaatactacttccccaacgctttcttttagatatccaaaagcttttccttcaaaaatcatgccgttttctaatataagctttgctttcatacttaagcctcctacaaatatatttttgctaaaactacaccttatgaatctttgtttaatataaaacaaaaggataataaagagatttcagaaaacctgatctcttcactatcctgtgatataccatacaaatatttgaattcaaaaaataagctatgaaatttttcattcagctttcaaatatcatagttatgcttccctttttggcctcacaggaccaagttaaagtgtatcttaacttttaaaatttctctttctaactattctagttgatagataatcctgtgtcaagataatttaaggatagtttaatatttaatataattatttttatttattacttattgtctattgcttatttatttttaatttattcaatatataaatcttatcataaaaataagattatataaagcataaaaatacacttatttgaatttttattcatatatttttttattttagatataaatataccattaattcaaataattgcttttgtatattaatccttaattatatgtgaattaaaatatgtatcctaattaagtaactaaatatttattataataatgccatatttaaatcgatataatacatgcatatttatataaaaaaagaataatagctaatataaatactaactattattctttaatataattcttcttcctaacgctctagggattaatttatttcctaaaatcaacagcttatttttatatcctggaataattattgtcctgcccattgaaaattctctgtaagcatattttgctatatcactagcattcattaaatatcttttagatctttgtgacttttttataccagccttctcttgaaatgatgtccttacaggcccaggacaaaggcaacttaccctgattcccaaatctttcaactcatcatggattgcttctgttaatgataaaacatatgccttgcttgaataatatatagacattttaggaccactaataaatgctgctgttgatgccacatttaagatgcctccatgtcttctctcaaccatctttttagaaaagtactttgtaagcatagtcaatgctgtaatatttatatttattatcttttcttcaagtccctcttctaaatcatgaaaaaaaccaaagcaacctatgcctgcattatttattaaattatccacaattaaattcttttcttccacaacttctattatctttttataacctttatccacagataggtcacattgaattatttctacaattactccatattgatcttcaagcctacttttagcattccttagcttaatttcgtcttttgctataataattaaattatctttatttttggcatagatctttgctaactcaaatccaattccgtcactaccaccagttattaatgtatatctgtttaaatcagtcattataatccttccttttaagatattctattagtttacaagctatatttccttgctattaccttagaattataatcatgttcatactccatttatacacaaatgattgctaattgcaaatttatataatttatgttattatataattaataaaatattcagaaaatttaggcagttacagttaattctgaattgacctatcttaaatttaatactacattttgtttttgtatatataattttaactgctttgtccacaatttaaaattgtttaattataagttctgctgtttttatattagtaacaacagctacattatgtacattacaaactctaagcaatgctgatacatctggttcatgaggttgcgctgtcaatggatccgtaaaaaatattactagatcaatctttccttctgcaatacgaccacctaattgttgatctcctccatatggaccagataaatatctcttaacttcaagacctgttgcttctgatatcttcgttccagtagttcctgtagcaactagctcatatttagctagtacatccttatacttctttgaaaattcaataatatcttccttctttttgtcatgtgctattaatgctattttcacaattatcgtccccctttttagatgtatttgatacgttttcacattggattatactatacttttttgtagttataaagtctatttaatattattattttatcatataaatatctatatattattacaacacactttatatattttaagattatttccttggcaatacttaattatgttgatttattcatgaaaatattaatttattatctttaactattataatatataagaatataaagaatatcatgaaataatattctttatattctctgtattatcttatttggccatttccataaattatatatttgattgttgttaattctttaagtcccattggacctctggcatgtaacttttgagtgcttattcctatttctgcaccaaaaccaaactctgaaccatctgtaaatcttgttgatgcattaacatatacagctgctgcatcaactctttgtaaaaacttttgtgaatttttatagctctctgtaataattgcttccgaatgccctgttccatatttatttatatgcgaaattgcttcatctacatctttaactacttttacggcaattatataatctaaatattcttttccccaatcctcttcagcagctttctcaatgtcgttaattatagattgtgatacttcatcacctttaacagcaacgccgttttctcttaaggctttaactactatcggcaaaaagtcctccactatcttttcatttataagtaacttttcagctgcattacaaacagaaggtcttgatgcttttgcattaataacaatgttttttgccatttcaaaatcgcagtctttatctacatatatatgacaattacctgttcctgtttctataactggaacagtagcatttttaagaacagcttgaattaatcctgctccacctcttggaataagaacatctataaactcatttaatctcatcatttcagttgcaacttctctacttgtatcttctactaactgtactgaagccttaggcaaaccagatctttcaattccttttgttaatgccttaactatagctttattagaattaatagcttcacttccgcctcttagaataacagcatttccagtctttatacaaagtcctgctgcatcacaagttacattaggccttgcttcataaattattccaataactcctaacggtactctcttctgacctatttgtaatccattaggtctttgccacatagatattacctcacctattggatcttgaagttttataacatctttaagccctgctgccatactttctattctttcatctgtaagtgctaatctatctagcatagcttttgaagtacctttcaatactgccgcatccaaatctatcttattagctgatattatatctccttttgcctttatcaactcttctgccataatcataagtgcatcatctttttgctttgttgatgcaataccaagatcataagaagcatttttagcattttgtcctttaattattaactcactcatttttagcccccatttcttattttacctacgatacaaataaagttcctatttcttcacccttcaaaatatctattattatatctggttcacttccattcgctaaaatcatatctactcctgcttttgtggatgtcttagctgctgataattttgtgatcattccaccagttcctagatttgatcctgcacctccagcgcactcttctaactcaggagttatttctctaacttcatttagtaattttgcactctcattattccttgggtctgaatcatagaacccatctatatcagataaaattattaacaaatctgcgttaattaatgatgcaactattgccgataaattatcattatcaccaaatctaactatattctcaatttcatctattgaaactgtatcattctcatttactataggaattatattattatctaataaagtttcaaatgtattgcatacattttccctaatatgatcatcttctactacatctcttgtgagtaacacttgcccaaccacatggctatattctccaaaaaatttactatatatatgcattagttcgcattgtccaactgctgctactgcttgcttttctcttatactttcgggcttttctttcaattttaatttattaacaccaacagcaactgcacctgatgtaacaagcgtaacctgcttacctgaattaactacatcagataatacgcgcgttagcttttcaattctacttaaattaatatttccattatcataagttaatgttgatgatccaacctttactactattctactagcatcttttaacctttgacgaaagcccatttttccatccccttaaagtctatttattctttataatttatcttactatacctaatatatcttatcaagttttaaaagatgttttataataaaacaatctagttccatatgaatgtaattatatttttataaaaaaataaggataaaaggaatactaaatttatttaaaataagtatttcttttatcccctatataacctactagattaatgcaacttaaaattctgatttaaattatatatacaaatacacagataaaatgacaaagggttcccaacataataaatatatgaaatatttcatgtcttccaaagagccatacttttattttatctgattttaatgcgtatattattccacctattgtatacattattcctccaagaactaaccatgatagtccaaatgaagataaaacttgagacattggatatatggcaaatactgcaaaccacccaattcctatatacatgctactgctgagccatctaggacaagttacccaacataatttaaatgcaattccgattactgcacatattgttactgctagaaatagatttattcctacctttccatttaacgccactaggcaaaatggtgcatatgaccctgctattaatataaatatcatagaatgatccaatcgttttagaatttttattactttatcatttgctattactgaatgatatgttgctgatgcgctatataataaaatcatacttatcccgaaaaataaaactgatacaaacgttattgtagaacttccccttgtatatacctttactagcattgctattaatgcaaataatgatagaactgctccaataaaatgagttaatccattaataggttctcttaaatatttctccattcttttaccctcccatttattcccacgtagttttaataactacgtgttgctatattagaattatttcatatttttttttatattgcaaccctatttttgtttattttctatttattaaatagtattttacccataaatgcttgaattatctacttcttttcgataatattaaaattataataatgacatagtttctattactatgtgaggagtgaaattatatgaatgactttaatattgatgcatatataaattcacaaaaatcatctaataacattaacttaaatgattttcctgaaattgatttatatatggatcaagtaatgcagctatttgaaagtaaattaagctacactaaaagaaatgatgatgacaaagttcttactaaaactatgattaataactacgccaaaggtaatcttttaatgaaaattaaaaataagaagtatactaaaagtcatcttattttaatggggttaatttataatttaaaaggtgcactgtcccttacagatataaaaactatcttgagccccataattaatgcttttgaaaaagaagaagaatatccattacatgatatataccaatcctttcttgatatatatgattcaaacttagatgatttaaaatcttcctcaactaaaatttatgataatattacaaatctaataagtaatgaagataattctctaggagactatgaagagaaacttctacttatatgtgcatatgttagcatgagtaatctttatagacgtatgagtgaaaaaataatagatgaatgttttgggagtgccaaaaattataaataatattaatttcaattaagtaataatacaaaaatttaaaattatagaaatacttaaaaatgcaaaaatcattaattatatgatataataagcaacatgtagttaaactatttatacgatgcacaattaaggatgaaattccaaattaatttatgataacatattttaacgatagaaaggattttttccctaattgtgcattattacaattaagaagaaatgaggtcgaaatatattgataaacgtatcaaatgttagtttgagatttggtggacgtaagctttttgaagatgtcaaccttaaattcactccaggaaattgttatggagttattggtgctaatggagctggaaagagtacattcttaaaaatattatcaggtgaaatagaacctaatactggagaagttacaattgctcctaatttaagaatgtccgttttaaaacaagaacattataagtatgataattttcaagtcctagaaactgtaataatgggaaatgaaagactataccaaataatgaaggaaaaggatgaaatttatgctaaacctgacttttctgatgaagatggaattaaagcatctgaattagaaggtgaatttgctgaacttaatggttgggaagcagaatccgaagcatcttcacttttacaaggattaggcataggaactgatcttcaccttaaaaatgtatcagaattgactggtggagaaaaaattaaagttcttttagctcaagccttatttggtaatcctggaatactaattctagacgaacctactaacggtcttgatttaaaggctgtaaactggttagaagactttttaggtaactttgatggaactgttatagttgtatcgcatgatagacacttcttaaattcagtttgtactcaaatggctgacgttgactttggaaagataaaaatttatgtaggtaactatgacttctggtatgaatcaagtcaattagctcttcaaatgtcaaaagatcaaaacaagaaaaaggaagaaaagattaaggaattacaggactttattgcaagatttagtgctaatgcttctaaatctaagcaggctacttctcgtaaaaaacttttggataaaattactttagatgatattcaaccatcaagtagaaaatatccatttgtaggttttaaacctgaaagagaagttggtaatgatatcttaatggttaaagatttatcaaaaacagtagatggtgttaaagtattagataacgtgaatttcatagtaaataaaggtgataaaattgctcttattggtaatgaaatagccgtaactacattattcaaaatattatctggagaaatggaaccagatagcggtgaatataaatggggaataactataactaatgcttacttcccagctgataactcaaaatactttgacgattgcaatctttctttagtagattggcttagacaatattcagaggaaaaatctgaaagctatatcagaggattcctaggaagaatgttattctctggtgaggaagcattaaaagaagccaatgtattatcaggaggagaaaaggttagatgtatgttgtctaaaatgatgctttctaatgctaatgtattaatgttagatcaacctacgaatcaccttgaccttgaatcaattacagctgtaaataatggtttgaaagattataatagtaatatattatttgcttctcatgaccatcagttcgttcaaactatagcaaatagaatcatagatattaaagatgatggttctatagttgatagaactatgacatttgatgaatacttagaattttccaattctaataaataataatttaaccatataaattaagattatatgtaatatacttataataaaaagttcagcatttctataaattgctgaacttttatatttctttaataaattattttccatttaatttgctgaataagttataatctctaaattaatcttttatcttagcatatcttctattacttcaaaaacatgatctacaagattatcagcatatggtttaattagttcttctactgaattaaatgtataactattattggtaatcttaaacatggaaatatcattcattgaatcgccgaccgtatataagctatcaacgcccttattttcatcttccaaaatcatcataattgcatttccctttgaacaattctttgcaactatatctacaaatacttgatttctaaaagcttctatatactcatcatattcatttatcaacttttctcttaccaattccgatttttctatagattgagatacattaaacacactcataatttgtgaatctgatacgctactcaatgcttcttctaatgttaccctattagaaaaatgattaaaaaaatcagcatctacagctgaaacatcaactaatttattttctatcatataagtatcatttccatcatcataatatattaaggaatctcctatatcataaaaatcagctattattctattttgtattttattcggtattgatttctcatgtataatattgtttctgttatccattatcactccaccattacacataaccaagtaatcatactcaaatggatattcctttaaaatactatttactccttttaaacttcttcctgttgaaattattatcttatttccaaacgcttttagtcgcctcaatgcatctaaatccttttctgaaattttgttatctctaaatagcgttccatctaaatcactcgctaaaaatttcattagtatcccccagttccctcgttattttattcaatttggtaatgattatatatactgctcataaaaaatgtttctctatacactccctatttatatttaattataagtgtaaactagaactaattacatttatctagaatctaaaatataaacttcatattttaaatatatctatttatatctattcctaatccattcaatgtaaacttaatagtactctctataatatcttctaaatttatcttctctatatgtatagattcatatattgcagatgaacatagtgatccaaaaaattggaatgcaataagttctacatctccttttttaatttccccaatttccattgcagttcttatattaatttcaatttcatttatatactttcgtatcttatgacgcaattcattttgtctatgctcagtcccccacaactggctcattactattttaaaaaaatctgtatacccatataaaaatgttaattgtattctacatatttttattaatttttcaataggacctatattgatattctgaacttcaataacttgattttgtaatatttgcaatccctcctcaacaatgaaattaaatatttcctctttactcttgaaatgatagtataatgtcccctttacaagtccagcattggcagctatatcatccatagtagcacctctatatccagattcagaaaatatttttattgcagattcaaaaatcaagttttttgttttgttcataacatttctcctcatttttcaataattacttatgctaatattatcaatatattatatcatttagttcattattaaaccacaattctacatattactatttatatcaaaaatgaaactttcagtacatataatcttacttttgaaattttgattatctgtgataaaattaatattaaggtaaaaaataaactatgtatgttacacataatttattcaatatatcagtttttctatattatttactaaatgattattctatagatttaactagatatatctaattaaaataagaaatggaggatacttgtcataactgtaacattataaatctttagagctgttatctctaaattatttaataaagttttgacatttgtatttatgattcaagtatataatagaactacaaaatcttatgaagaagaacttatcgctggaaagaaatatatagaatggacctatgaatcaccagttggtaaaacaattactgaacttattgcaaagaaaaaattattttctaagttatatgggaagtattgtgatacaaagctaagcaaatccaaaatttcaccatttgtagatagctttaatattgatatggctatgtcgaagaagaaaattaatgaatttaaatcttttaatgatttctttacaagagaattaaattttgatgctagaccaataaattcagataataatatattaatctctccaggagatggaagaataactgcctatgaagacattgacttagataatataattcaaattaagggattaacttatagtttaaaagagttaattaatgatgataatgtagctagtaaatataaaaatggaatatgcgttgtattacgcttatgccctactgactatcatagatttcactttatagattctggtattccatatgaaaatcatcctataaaagggcactattattctgtaaatccaatagctttaaaatctgttcctaaacttttttgtgaaaataaaagagaatggtctttatttaaatcagataactttaaagatgtacttcatatagaggttggtgctacatgtgtaggttcaataattcaaacttattcccctagagttagagtaaataaaggtgatgaaaaaggctattttaaatttggaggatctacaactatattattctttgaacaaggatctatagaaatagatgctgatattatagaacaatctaaattaggttttgaatgtaaagttatatttggtgaaaatattggtactaaagttttataaaataaaaagaatggggtacccattctttttattttggcagagcgtgaaggaatcgaaccctcaatgtaccgtccgtagcggtatgttatatccgtttaactaacgctccatattcaattttcacaacaagtttatcttatcacaagcggttataataatcaagtttataatttgattattctcataattttataaatttaatactattattcaacttagtcccatatacaatttggaataagttatctaaaaattaggtttaatttttagataactatccttgttcatgatgacttttacaaatatatatcagaaaactctacctcaagtacttccactttacttttaatatttaaacatttatctctattattttcatcatcctgtaatctttctattggtagcttaattataaattcacaaccagaattctcttcacttttcaattcgatactaccattatgagcttgagttaagtatctaactagatcaagacctatcccacttcccgaattctcagattttttatttcttgaagattgaacaaatctattaaaaattgtattttgctcttcctttggtatcccaattccttcatcccttaccgaaatagttaattgatttatacttttccacgcatttatatatatattacttccctttggcgagaactttattgcattagaaattaaattcattattattctatctattgcttctgggtctactgccattatgcactcttcaacatttgtatcaaaaactaaagagatctccttctgcttagcatatttatctattgaagatatattccactctattaaattaattacatctaaattctctcttttaatactataatgatttttttctaattttgttgtatctattagattgtttacaagttttaatattttatatgaatttctttttataacatccatgtgatcctggcatttaccataccttttaatatctttataatcatccttgtaacattgtaaaacacttaaaattatatttaatggtgatctcaaatcatgtgaaatattcaaaataaaatcttcttgatttttcttagattctgataaattaataagtttgctaactaattcatctttcgataacttaataaggtcatttttattcaatatattttccctatcaatctgattatctttcaaaatattaacctcaaccatttttaaatccccttttgtaattttttttactttttttaccatatacccttaatatataatatcacataacttcccggctaacaaccatattaaataaatttgatatgatatttctaattccaaaagattatataattgttcatttaagtttaataattgaatattacaaatttagataataatttgaaaaatttatatatatgcttatattactaagtatagtttcttattatttcatcctttatatactttaatatcaatattacataggttaatgttccaacaataaatatagtatcaaagcttatattaggattagctatttctagtattatttgtattattaatggcaatgtagccgcatataaggttaaagaatataaagctatatatttgactaccattcttaaaaatactgcaaaaagcgctgcaacaattgatacaattaaggaatttaataataaattaaaaagtattattgaaaaatatgctaccgtttgatctactaaagatattatatctaaattataattcttatattgaacaaatgcactctttaagcctcctaataagaaactaaggaatattgcatatgagattgatcgtaatattccttctttcgcatatttagaaaaaacctttatgtcatatatagaagttataagctttataaaaaaattagttttattagtcattttcccctccagataaatattgtctactttcataaggcctattaagtatattaacacatattaaaattagtttaaacttcaaggtttattatttacttttattgtcaatattatataaataaaagaggactttgtaattaaataaaagattaatcggcaatatcttattcaaattcactctaaatatattagttacttcattaggaggcatttatttgagcataaatacattttattataaaaagttaaaaactaaaaaattacctaaaagaattatatatgtattagctttgttaataacattatcttctagctgcttttatgagttatacagttataataaacttttaaataacttcaaatcagattttgataattataaattttctgaagctaataacttattaataactaaacaaaactttaatccatttaaattatctatgattagtcatgatgtatccaaatatcttagaactaaaattaatactttatcagatgaaatccaagataagaaaatttcttctgaagatgccttaattcaggttaaggaaataaaacgttataatctagtgaatgatgatgatctacataatgcttctgattcaatagacttaattcaagattctattaaaaattataactctggtattaattcttttaataatgaacaatattcagaggccatttcattctttaaaaaagtttctgctttagatcttaactatacagattcacttatatacctagatgaatcaaaaagtaaactaaaggaggatttatttgcttactgcgataatttaattagcaatgattactatagcgaagctatgtctaaaatttcagacaataatgatcttttaggtgatgacatagatgtaaaagaaaagatagcagacataaaagaaaaacaacaagaatacttagataaaaattcagctattgctgaagcttcatcgcgtgccttgacaaccaatattacatcgaaaaatattaatacattaaatatagagagtacaacaccttatcttataaacgtaaacattcaagatcaaaagacttatgtttataaaggaaaggctgataaatggcacttggttaaagcattcccttgttccactggaataagtggagaggatacacctcctggatcatttactattaaagagagaggtgattggttcttttcagaagaatataaggaaggtggaaaatactggactcaaattactggagacattttatttcattcagttccatttgctaaagacaaaactacagttctagattatacaatgaataaaccttcttctcatggttgtattagactctctatagatgatgccaaatggatctttaccaacatacctagagaaagtaaagttataataaaataactattaaaaaagcaagaagataaatttatttttgtcttcttgcttttcttattattttacttaaaaacatttatattattttaatttctttttctaaataaaatgaatataagtacttatatttaacctttttacctgttaacttaaatattgcatcactataataatctaattgtttcctatatttctctttaaattcatcttcatggccttccatgatataatccgttttgtaatctataagtataatatctcccttatattcaaagaaacaatcaattattccttgtaatcttatcttttcatccttatatatattatcaagtgttttatctacttctaaactgcttatctctgtataaaaaggtatttctctataaatcttttctcccctacaatttaaatcaagaatttttttccctaaatccgacctaaaaaagctcagtattttagtaggattaattacctttaattcttcgctaagcaaaaactccttttcaaataattcgtgtaattgttctttaatttcctccgtagatgatactctattaaaatctatttttttcattacaaaatgaactgcagtacccttttctgaaggagtaagacctttcttttcttgaagaaacttaggaacaacttttactttttctctgtataattgttcagtatcataatcttcttctgcatgccttctctttaaatctgaaactgaaatattacttttaattgttgttgaagctttaaatggatatttatatgataatattttatctacttcttcatataaataattatcatatggtttattatttattattgttaactcatatccttcaccttgttctaacacttctgtctttgtcttatcaattaagtcgcccttattccaaaaactaactttccacctagaattatcatcctttaatattaaattttcagttccaaaactttctgataagacactaccatctctatgttggcatagtgacatacaaatccaatctaaatatgactttccttttaaaacttccgaaggggatatacgattataatctaaagatgctgatcctaaccatttttcagctgatttttcaagatttcctactgtacctgtcataatcaacttttcctttgccctagtacatgctacatacagtattctcatttcctccgacaatgtttcaaatttcatctttttctttattgattctttagctaaagttcctatgctaaacctttttcctatatctataaaatctggcccaagtcctaattcatcgtggtacaatatgcttttatttaaatccataaggttaaaattctttcctaacccgcataagaataccactggaaactctagccccttacttttatggatactcataattcttactacatcctcattttcacctaatacttgagcacttcccatgtcacctgaagattttataagtttatttataaaatttataaaattaaataatcccttaaaactcgttttctcaaattgtcttgctctttgaaaaagtatttttaagtttgcttgcctaagcactccatttggcatagctccaacatatccataataagcagtatccatatataaataccatataaattcatcaattgccatataaattgatttatttctccacttgtcaacggaattaataaaatacttacatttagctatcaatacatcagaataagattcattaattgaattataagcttcttcacttatatattttatattttcataaaaataattatctttttttacaagtctaatatcacttatttcttctgccgaaaatcccataatgggagatctcattactgatattactggaatgtcctgcattggattatcaacaacctttaaaagagaaattattgttctaatctcaattgattcaaaataaccagatcctgtatctgcatacactggaattccttctgcacttaactcatctaataatggctctgaccagtttttagtggctctaagtagaataactatatccctatattttaatggcctatattcaccagattccttatctaaaactttaaaaatttgttcatcttcactttttgacattagttctttaattcttttcgcaacgatcctaccttctaaaataacattatttatttcttcctgttcctcattatcttctacaaccgtttcattatggctcttatcaattatattaacttcaatagggcctccaacaattgtatctttgaatttattttccttaaagtctgcgcctaaatttaaagcctcctcatctgtatattctaactctccaacaacttcagacattacttctttaaagatgtaatttactccatctataatttctcttcggcttctaaaattcttatataattgaatttttctatttactccattacttgaatcatatgtattatatttttcaatgaataattcaggttttgcttgtctaaatctatatatactttgcttaacatccccaaccataaatacattgggattatcatcattttttctggatactaggtttattattgtttcttgaacgttatttgaatcttgatactcatcaacaagtacctcatcgaaatattctttaaaattcattgcaatacttgatggaattatattattctcatcatcataatcacttaatatttttaaacataaatgttctaaatcattaaaatccaatatatttctttcacgttttcgtttactaaacctagcactaaattctagaactaattctatcaatttttttatgtagggatatgacccttgaatattccttaacatttgctgtggatttactgaatatgcattatttaataattcagatattccttttttaacatcatctctaattttttttacagtattttgagacagctcatctgaaaccttatctttttttatagattttaatctactgaattgtactgatgataatgaattaaacattgcctcaagtccattatcagtagattcataagccttctttatataacttaattccattaataagttatccatataaggttctaatccatcagttttgctcgtaacctcaatggccttttctaacattttaacatacccatctaactcaatttttacgctttgagctaaaactcttacccaattagttctatctaattcatctaattgtttaatattaaaggcctctgcactattaatgagccatttttcaggccatgggcctgacattgtaaagttatataaatctaatactaaattttttaaattattatcatttttataactactaaatatctcaaccaaattagtgaacccaatatcttcttcctcatatttatcttcgaaaagttcttcaataacttccgatttaattagtattccttcagtctgatcacctattctaaatgatggatctagatcaatcctatggtaattatttttaattacatctaagcaaaacgaatgcattgtagtgatattagctctatttaacagcgttaattgcctctgtagatttttagacctaggattattctctaattcctttgatatcgcatctgctatcctttccctcatctcagctgctgctgcattagtaaaagttacaaccaataacttatctatatcaactggattctcttcattagtaattattcttatgatcctctctactaaaacagcagttttacctgagcccgctgcagctgcaactagtaaattacaatttctcgtttcaattgcacttaactgttcatcagtccattttgtattacccatatataaatctctcctgtactaattaaaatcgctttaactgtaagaaaacctaattaattttaataaaaaatatattagattcttttatagcactatacttcctcattttcaaccttaattaatttattagaattatcaatttctttttttatattattccatatatcatttgtagatttgtttattataattttgtatttattgtcttttatttctgtatcaaattggcatattgatgaaaaatcacagtattcacaatgagcaatgttagaattcttagtcggctgaattttaatatctccacttagcatttcttcacatatctctatcatcttcctatttacatattctctaagtattctaaactcctcttctgttacaacatcactggttgccttaaaacctccatcagccttaaatgatgctggtataaccaatgaatatccttctatatccttatccatagcttttacaaccctcgcatcttttaagactaatcctttcatctttaaagcacttaatacttccttctctacttcttcgtcagtcatttctttcttgctttttattataggatcatctattttaaagtataatattgctcctggctttacttgtttatcaagtatatattttgaattctttataagtgcatctaaatagactaataattgcacttgtaatccataatatatttcatttaaatcaaattttttagctccagttttataatctataattcttatataagtttcgccatctaaatctaacttatctattctatcaattcttccttgaagatacaccttttcattatcattcaaatctaatgttatagcttctccagagctataacttccaaaatcaaattcagttttaaatacttcaaattcaccttttcctatttgacttgcaataactgaaacagatttagatattactcttttaaatctttgcgctaaatatttaaatttcttagtgctatttaatatagaattactttcatccattaacttcttatcaataaggttagatattatctccttacatttttcattgcttaaatcagaccatagtactccatcttctctaactttattagtgaatgaatcaagcatttcgtgtacaaatgatcctaagtctggtggtgtaaattcatatacctttctatttttagcttttagtccatattgaacaaaataagaaaaagggcattctgcatacttttctaactttgaaacactaaatactaacttttctaagtcattctgataaagttttctaagtttgttttttgaaactttatctccaatgtttgagtaactaagccccttaaatatatttttaactttatccctaaactcatcattgtttttaaaccattcatatacctcagaccagtaaggctctatatattccttatcaaaatcttttctcatagaaattataagttcattaaatgttggaattggtgcaataattttgccaaatttattttcaagaattttcaaatcataaattgcactttcttcaattaaattaggaaatatctttttaattctagatattactatagatggtcttaatgatttaccttcaaaatcagccattggatatgaaagcattaaatattcactactaattgttaatgccatatatagtagatactgttcttcaaaaactttatttctagttgttgatgataaatttattccaacctcacctaatgttgttctatctctatcagataataaaccttcctctttcttggatgctggtagaactccatcattaattcctactatgtaaagaactttaacatctctgccctttattcttgctatatctccaatattaacctgatctaatgctacaggtataattcctatctcttcattggcgaaaccagaacttaatattctaaaaaattcagaatactctaacctctcttcgcctataacatcgaccgcttgatctataatatctataactatactttcaacctgactatattccttaactttatcttctaatcctaattcttcaaaatttttaatccattcgttaattctgtcaaaaacttttacatccactaaaaattcataaatagctgaacatatatctttaactttatgttttccatttactttattatgaaaagtcattaatggatatcttatctcttccataatttcagctattaaaactttatcatccgtcaattcaccatttcctctaaaccatttctcatttactatttcttttgatgtccatttataaccctttaccccatattctaatataaagttctctagcctatctatatatgaattatctattccagttaagccactctttaaatatttaaatacactttcataagaccaattcttaagcaaaatttcaaaagcagaacttataagtacaatcaatggattacttagtaattgaatctttttatctaaaaagtatggaatattataatctttaaatattactgatattattttttcataatcatctatatttctacaaactacagatatatctctatatctataaccattttctctcaccaagcttgtaatgctttttgatactctttctatctcatcataaatattacttgctttgtaaagtgttatactctcagggttcttatcatattcattaaatgggtaagaaaaaaaatacttttctatatgatcaagttccagattacctttaaacctataaggaattgcattatttaagttgactggcttgtcataagctatgttgttttctttcattatctttaatattttattttcagtactctttataatattgaatacatcagttatatcttcagagttgttatttagagatttgttatcaatacaaaaagttatattaactcttctgcatctcttggctaatacctttataatatctagttgttgaggtgtaaagctagtaaattcatctatccagacttctgaatccacatacgcgctactttctaataactttttatctagtagtgttaactcatcatctccatcaatataattttcatgcattttcaagttaaatgcttcataaattatcatcaattctttaaccttttgatataattcagcatcatttattttctcatctattgctcttatactatcaatgctaatattatattttttaaattccgaaatcacttctgatataatttcattaaatccttgttctctagacatcctattaaaataatccagaaactcaatattttcatttataactctatgaattagcatattccttccagattccttaataatctctttaactcttccaccatattcttcaaaaatattatgagccatttttttaaaactcagcacctctgtcctaaaaaaagcattttctcctatttcatgcaatattttattttcagtcataaatgtatattgttctggaactaatagaattaacttattgaaatctaatttcttatcaatattattttttatctcgtcaatgcaaaatttactcttgcctgttccagatcttccataaacaaatcttatactcatacgtattttccatcctcacattttaaatatgaattatatctttctctaattatccccataattataatatctatatattctctatctatatagctagaatatcttttaatatcctcctctataaacccacattttttataacaatttatagctcgcatattataactagcaacgtatagttctactttaatggcatttagctttttaaataaatatcttagaagaatttttatagaatctactccataacttcttccccaatactcactccctatcgttatgccaatacagtatatcctactataatgtccttgctccttgtacgttacaaaaccaattaaattatcgtcttcattaattatacttaaagcttttcttaaatctactttattatccatgctatcaattattatattatactttttaactttctcttcactatgtaacttgaataatatacttatatcttccttttttagtactcttaaatacactttgctgccgcttagcataattcaccttcttataataattaatttattttataagcagatacattaattataatatcttaagtttatttactccataaagttaattaaaaacaaaaaaaacatctaacaatttgttagatgtttggcggaggatccgggatttgaacccgggcgccagttacccgacctacgcccttagcaggggcgcctcttcagccacttgagtaatcctccatgtgccttctattttaatggcggaaagatagggattcgaaccctaggtacgcttacacgcacgccggttttcaagaccggtgccttaaaccaactcgaccatctttccatgtctcacaacaaatatgattatatcaactaattttatttatgtcaacatatttattgcaataaatttaattttttcatttatctaaacttaattttagctatgagttacagaatctcaaataatttagaatagtaaattatatttattgagaattcatatataaattttcaacaaataaaatatatgttttactaagactaattaattatactaaaaagcacctaacaaatgttagatgcttggcggaggatccgggatttgaacccgggcgccagttacccgacctacgcccttagcaggggcgcctcttcagccacttgagtaatcctccaaataaactttatatttttagacaaaaaaatggcggaaagatagggattcgaaccctaggtacgcttacacgcacgccggttttcaagaccggtgccttaaaccaactcgaccatctttccacgtctaatgacatgtattattatatcaattacttatacttatgtcaactattttataatattttattaaaataaattattataataaaatataaccttatggctttagtgtttggctattattttatcttccttgtacatattatatctacgccagtattaagtatattcttacatatattatcgccaatatttgtaggagtactaacataaatcctactaagaacctttgagaattccttccataagtgcttctcaacgcttttattactttttactgatacaactttgtaattgatattaccttttactctaaccaaactggtaaaaacatctttattaggcattactaattactccaatctaaatttcattaaattccttaattcttccaactaaaatttgtgaatccatagaatcatctactatatccaaaacacttttatccatctctctggccaatatctttattatctttatattgcaacttgaaccattgcagtttccaagacctattcctgtacgcctttttacaccctctactgttcttgcacctaaaggtcttcttattgaatcaataatttctccctcagaaatattattgcaattacaaataatattaccataacgcttatcaagagaaattattctatttatttgatctttagtcatctctctaaatatatatgtttctctctttttatcaatataatccttcttcttcgttatattcatgcttactttaactttcttttcaatatcctgagcaattgctggtgcaactgatattttagcatagtgatttcctataacctttatataaccatcctctaagttactatcatctattaacatatcattttcgctatatacttctgtaaatatattaactattgactctttttttatatttttcaatattctttctggtaattctgatttagcgctaaaattatcactaatcttaattccaattaaattttcattttccgatattggcacctttatcatggaattttcttcatctatatcttcaataataattttctttaagttatcacctatgcttttcttaactattatacacctaactttttcatttttcattttgctttttacattactacacatatcattaaaggattcatttggaattgtattaataactagtttacaagtaaacttatttttattcgtagttactctgaatcccttagaaatagtcttaatatctataacctcttcttctagtctaaaattcactccattatctacagctatttctgcatatgaaacagctaggttatatggtgatattattgaagtattatcagaataaatagctttatttgcctttaaatttaaacttggttctacattataaagttcatcactatctattatactaactccgtctattcctcgatccctagaatcactgtacactttatttaatagctcactactctcatctaagaaaagccttaatgaaccaatcttattatatctaacattgaactttttacaatgcttccttattatatctatacctctcttctccaagagagccattttactactacttgattctgaaccatcataaacaacagctgtatttgcaaatgaaatatcgtttgcaacatcatatcccttttcaattaaagctatatttatattatattttgaaagttcataggcaactgcacatccaattatcccaccgcctaaaattagcacatcataatccattactagtcctccaaatctgaaactataaagttgttctttttcaattccaatataattaaatcaatatcatcttgagtttcagctgctattgtgtgaagatgaactccattagttaatgcagatagtaattttgctttttgttcattatatttttcaataaacttatttaactcattataattcttaatcataagcattccttttatttctccatacaatggatgttccactactacatcttcaatcattccaccatatttgattactatacttaattcctcaatcatctcatcttcagtatgacttactgcaataattgctttagctttattattatttgcattaattatatatccatctggagttgctattatattcttacctttggctctaagaattgctatatcttttactataacctgtctagttacagaatatctttttgctataaagctgcctttcaaaggctcattactttctagaagtaatttaattatatcctctcttctctcaatagaattcatatttccctcctattttaattgcaatcatcagatatacttaatacttttaaatatatatttttcgagtcaatatcacctttattatgatgatatttaatagaatttattacctctaagcattcatcattattaatactctcaatcagtcttgctccaatttccggatgattataataacttattattttcttatttttattatacttcaaaaattttccgcgagtaatactatttaaaaaaacaataatgcatttataaaatatatttaattcggattctaattttcctatgtcatgcaataatgcacacttagacatcctttttttatctatatcaactatattattatcatctatatattttatagccgttctacaaactcttattgaatgttgccgctctgatttagtaagtttcataaataagttcaactcagaaatactaagatacttctttagcatttccatatcttccttaatgaatatagattctattgcccaataaaattgttttattctgtataaaaacattcccatctcctatgcttattcatagcatacataattaaataattgtataataaaaaaagttatgaattacttcataacttcttaatggtggagataaagagattcgaactcttgaccccctgcgtgcaaggcaggtgctctcccaactgagctatacccccatggtggaccttcagggactcgaaccctagacctaccggttatgagccggttgctctaaccaactgagctaaagatccgtaagttaaacttctttaacttaactcttgtaatctacaagattacctcgcaacgtcctactctgccacacagtctcccatgcagtaccatcggcgctatagaccttaactttcctgttcggaatgggaaggagtgttacctctatgccatcatcacgagatcattacaaacaatattatacttataaacatatattatgtcaagtatcttttaatattattctttgaaaattgcacacagtttctttaatgtatttacaacctgattatattggtcaagccctcgacctattagtatcagtcagctaaatatgttaccatacttacacctctgacctatcaaccttgtagtcttcaaggggtcttactagcttatgctatgggaaatctcatcttgaggtgggcttcacacttagatgctttcagcgtttatcccttcccgacttagctacccagctatgcttctggcgaaacaactggtacaccataggtcagtccatcccggtcctctcgtactaaggacagctcctctcaaatttcctacgcccgcgacggatagggaccgaactgtctcacgacgttctgaacccagctcgcgtgccgctttaatgggcgaacagcccaacccttgggacctacttcagccccaggatgcgacgagccgacatcgaggtgccaaacctccccgtcgatgtgaactcttgggggagatcagcctgttatccccgaggtagcttttatccgttgagcgatggccctcccacgaggtaccaccggatcactaagcccgactttcgtccctgctccacttgtaggtgtcgcagtcaggctcccttctgcctttacactcttcgaacgatttccgaccgttctgagggaacctttgggcgcctccgttacattttaggaggcgaccgccccagtcaaactgcccacctaacaatgtcctgtcaccagtttcatggcatccagttagaacttcaatactatcagggtggtatcccaacaacgactccaccaaggctgacgccctagtttcccagtctcccacctatcctgtacagacaataccgaaattcaatgctaagctacagtaaagctctacggggtctttccgtccaatcgcgggtagcgagcatcttcactcgcactacaacttcgccggatttgcagttgagacagtgcacaagtcattacgccattcgtgcgggtcagaacttacctgacaaggaatttcgctaccttaggaccgttatagttacggccgccgtttactggggcttaagttcacaccttcgcgttaccactaagtgttccccttaaccttccagcaccgggcaggcgtcagcccctatacatcagctttcgctttagcagagacctgtgtttttgttaaacagttgcttgtgcctattctctgcggcctgatttctcaggcaccccttctcccgaagttacggggtcaatttgcctagttccttaactgcaattcttccgtcggccttaggattctctcctcatctacctgtgtcggtttgcggtacgggcactacttctctctctagatgcttttcttggaagcatggaatcagatacttcggttccgtagaaccttccccatcacgcctcagaattgttggaacggatttgccaatcccaactccctaaacgcttagactagcatccaatagctagcacatcctatccttctccgtcacaccatcgataataacgattatagtggtattggaatatcaaccaattgtccatcgactacgcctttcggcctcgccttaggtcccgactaaccctgagaagacaaactttactcaggaaaccttagatattcggcctgtaggattctcgcctacatctcgctactaatgccaacattctcactcgtaatcagtccaccgctccttacggtacgacttcagcccgattacgacgctcctctaccgctcacgttaaacgtgaacccgtagcttcggtggtaagtttgagccccggacattttcggcgcaggatctcttgactagtgagctattacgcactcttttaatgagtggctgcttctaagccaacatcctagttgtcttagaaatcccacatccttttccacttaacttacactttgggaccttagctgacgatctgggctgtttcccttttgaccatggaacttatctttcatagtctgactgccggactgatagtatgtggcattcggagtttgataaggttcggtaagcgctatgccccctagcctattcagtgctctacctccactactcacattttccgacgctagccctaaagctatttcgaggagaaccagctatatccgagttcgattggaatttctccgctatccacagctcatcccatgctttttcaacagcaacgtggttcggtcctccacgaggttttaccctcgcttcaacctggccatggataggtcacccggtttcgggtctacagcatgcaactagtcgccctattaagactcggtttcccttcggctccgtaccttaagtacttaacctcgctacataccgtaactcgttggctcgttctacaaaaagcacatcatcacacacataaggtgctctgatcggttgtaggcacatggtttcaggttctatttcactcccctcccggggttcttttcacctttccctcacggtactgcttcactatcggtcatcaggtagtatttagccttgggaggtggtcctccctgcttcccacaaggtttcacgtgtctcgtggtactctggtgcagaactgattatcatagttttcacttacgggactattacccactgtggtccaactttccagttgtgttcaattaactatgatttctcgttatgttctgtccgcaaccccagagataaatctctggtttgggctctttccttttcgctcgccgctactaagaaaatcgatttttctttctcttcctccaggtacttagatgtttcagttccctgggtataccttcataaagctatgtattcactttatgatacatggggtttcccatgtgagtttcctcattcggaaatcttcggatctctgactatgtgcgtctacccgaagcttatcgcagcttatcgcgtccttcatcggctcctgatgccaaggcattcaccatgcgccctttgtagcttgacctaattattagtcatatcacaaagaatatttattcttggctttgttgtattttatatacattaaatctatgtgcaattttcaaagaacattgaaagacttagtctttcaaaattgaacagaacaaatacttaagtaacctttgagcaagtattttatattttgatacataataatgtatctgtactagtcagacatcatgctgatctagatttctccatagaaaggaggtgatccagccgcaggttctcctacggctaccttgttacgacttcaccccaatcgctgaccctaccttaggtcgctgccccgcttacgcgttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagactggttttaaagtttggctccacctcgcggtttagcatctctctgtaccagccattgtagcacgtgtgtagccctagacataaggggcatgatgatttgacgtcatccccaccttcctcccggttaacccgggcagtctcgctagagtgctcaactaaatggtagcaactaacaataagggttgcgctcgttgcgggacttaacccaacatctcacgacacgagctgacgacaaccatgcaccacctgtcttcctgccccgaagggcttccccgattaagagtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgttagcggcggcacagaggtcatgacaacccctacacctagtattcatcgtttacggcgtggactaccagggtatctaatcctgtttgctccccacgctttcgagcctcagtgtcagttacagtccagaaagtcgccttcgccactggtattcttcctaatctctacgcatttcaccgctacactaggaattctactttcctctcctgcactctagatatccagtttggaatgcagcacccaggttaagcccgagtatttcacatcccacttaaatatccacctacgctccctttacgcccagtaaatccggacaacgcttgccacctacgtattaccgcggctgctggcacgtagttagccgtggcttcctcctcaggtaccgtcattatcgtccctgaagacagagctttacaatccgaagaccgtcatcactcacgcggcgttgctgcatcagggtttcccccattgtgcaatattccccactgctgcctcccgtaggagtctgggccgtgtctcagtcccaatgtggccgatcaccctctcaggtcggctacgcatcgtcgccttggtgagccgttacctcaccaactagctaatgcgacgcgggtccatctcatagcggattactcctttaattgctatgccatgtggcactacaatcttatgcggtattaatcttcctttcgaaaggctattcccctctatgaggcaggttacccacgtgttactcacccgtccgccgctaatccgttcccgaaggaacttcatcgctcgacttgcatgtgttaagcacgccgccagcgttcgtcctgagccaggatcaaactctcaataaaaagtttaatcttagcttactcaaataaaaattgctggtttacttaaatgtatttatgttattctgttcaattttcaaagaccaattttctttcctacaattctcattgtagttattaattttcatcaccctcaagcgactttcttagtatatcacctgatttatacactgtcaacaactttttaaattttttttaaattatctcaaaaatactttttataaacttaattaaagtgtttttgtgtttcagcgacgttttttatattaacataataattcaatagtacttatgtaatatagcctaattatattaacttatgttcatattaatcaacatatctatataatacttaatatatcttattatgatacacctggcatatatgtatatatttttataaaattttaatatataatacctataaaaaaataaggctataacgtatattcaatagttatgccttatttataaccttataaaatttattagatttaatattattcttctatattatttatttcagattcagattcagcttcatcaccagattcggtttcttgatcatcactacttaatattttagctattgcaacaaccttctcatcttcattagttctcattaatgttacacccattgctgatctacttgttacagaaatatctgctacattaattctaatagctactccactcgaatttataagcattaattcatcatctaccttacaaattgtagctccagcaagctttccagtcttctcactaattttataagttattagccctactccgcccctattttgaagcttatattcagcaataggcgttctctttccatatccattttcacttattactaataactcttctccatcaacagcaatatccatacatactgctatatcatcttcttttaaattaatagctttaacacctgatgcagttcttcccatagatctaacatctctttcattaaatttaacagcgtaaccattttgagttacaaccataatgttagcatcaccataagtattctttacttttaatagttcatcaccatcttttaagcttattgcaattaaaccattctttcttaaatttttaaactcgcttaacggagtcttctttactattccttgcttagttcccataaacaaaaagccttcttttttctcatctgttacagtaagcactgtttgaatcttttcatcgggttctattgctataagatttatcaagtttgttccttttgcttgtcttccagcatcatgaacttcataagctcttaatttatacactcttcctttatttgtaaagaatagtacatcggaatgtgttgatgttatcatcaagtgctcaacaaaatcatcttccttagttgacattgcttgaattccttttccacctcttctttgtgatgaataagtgtcggccgaaattctttttatatatcccgaatgtgttaatgttatcacaacatcttcttcttgaattagatcctctatatcaatttcatttactattttttcaattttactttttctctcatctgagtatctattctttatttctaatagttcctctttaataacatctaacagtttttcttcactagctaaaatagattttaaatattctatttgtttcattagctcattatactcttcctcgattttacctctttctaatccagttaatcttcttaatctcatctctaatatagcctgagattgcttttcagaaagttcaaatctttccattagagtatttttggcaatttcagtagtattagaatttcttattatacttattacttcatctatgttatctaatgctatctttaagccttctaagatatgtgctctagcctctgccttgtttaaatcaaatatagttcttcttgttataacttctttttgaaattctacataattttctagtatttgctttaaatttaaaacctttggctcattattaactaatgctaacataataatgccaaatgtatcttgaagctttgtatgcttatataataaatttaatactacacttggattagcatctcttttaagctcaattacaattctcataccgtctctgtctgattcgtctctcaagtcagagattccagtaatctttttatcttttactaaatcagcaatattttctacaagttttgctttatttacttgatatggtatctcagtaacaattattgagtgccttccgttttcttcttctatttcagcattcgctcttactattatctttcctttaccagtttcatatgcagctctaattcctgctttacccataatggtagcccctgtaggaaaatctggtcctgtaattttagtcataagttccaaaactgtgctttcaggattatctataagcataatagtcccatcaattatttcagccaaattatgtggtggaatattagttgccataccaactgcgattcctgatgaaccatttaccaagagattaggaaatcttgatggtaatactactggctcttgctcttcgccatcaaagttaggcataaaatcaactgtgttcttattaatatctcttaacatttcaactgctattttattcatttttgcttctgtatatctcatagcagctgcactatcaccatcaactgatccaaaatttccatgtccatcaactagcatatatctcattgaaaaatcttgagccattctaactaatgcatcataaactgaactatcaccatgtggatgatatttacctaaaacatctccaactattcttgcacactttctatatcccttttcaggggttaatcccaattcctgcaatgaatatagtattcttctatgaacaggttttagtccgtctcttacatctggcaatgcacgaccaactataacactcattgcataatctatataacatttcttcatttcatttttaatatctacaggtataacttttccttcattaaaatccatgtacttcacctcgtatttcagtactaaatatctaaattaacaacatttctagcattttgttgtataaattcttttcttggttcgactttttcgcccatcagtattgtaaaaatttcatcggctgccatagcatcttctatgtttacttttaataaaattctcttttccggatccatagttgtatcccataattgagacgcattcatttctccaagacctttatatctttgaatatcagtagaattatcttttccacctaactctgataaaacactttctaattcaggatcactatatgcataatactcctttttactcttactaactttatataatggtggttgtgctatgtatacatgcccatcatctattaaattcctcatatatctgtaaaaaaatgttagtaacaatgttctaatgtgagcaccatcaacatcggcatctgtcataattataattctattatatctaatcttctcaacatcaaaatcatttcctatgcctgctccaaatgcagtaatcattgatctaatagtatctgcatttaatattctatctaatctttgtttttcaacatttaatatcttacctcttaaaggtaaaatagcttggaattttctgtttcttccttgctttgcagatccacctgccgaatctccttcgactatataaatttcacattcccttgggtctttagatgaacaatctgctaatttccctggcaatgtagatctttccaaaactgattttcgtgttaattctcttgcttttctagctgcatctctggctctggcagccattagagccttatcaacaatcattttacctatgttaggattttcctcaaggaatatacctatattttcaccaacaattgagtctacaattcctcttacttcgctatttcctaacttagtttttgtttgcccctcaaattgtggctcttcaatttttatagatattactccagtcagaccttcccttatatcatcaccagtaaaattcttgtcattctcttttatatgcccaaatttttttgcataatcgttaaatactctagttagtgcagttttaaatccaactagatgcgttccgccttcaactgtatcaatattgttggcaaaagaaaatatattttcagtataaccgtcattatattgaagcgctacttccacggatatattatctttcaccccttcaatatatataggctcttcatgaagtggcactttattcctattcaagtagctaacaaaggatttaattccaccctcgtaatggaaaacttcttctttctcatctcttttatctactaaccttatatatattcctttatttaagaatgctagttctcttaatctttgagataaaatttcgaaatcaaacactatttcatcaaatatttctgcatcaggcttaaaatatgtctgtgttccagtctggtcactgtcccctacttttgtaagttcgtttagaacctttcctttactatatttctgctgccatatatgcccatctctattaactgtgacagtacattcttccgaaagagcattaactacagatgcaccaactccgtgtaatccacctgaaaccttatatcctccccctccaaatttaccacctgcgtgcaatattgtcattataacttcaacagttgattttcccatcttaggatgtattcctacaggcatccctctaccatcgtcatttactgtaatcgaattatcctcattaatgtatacttctatcttattacaatatcctgctaaagcctcatcaatgctattatctacgatttcatatactaaatgatgaaggcctcttgaactagtgcttccaatatacattcctggtctttttcttactgcttctaatccttcaagaacttgtatctgattttcatcatattttctgttattttgttccaaatcagactcctcctaaacttaataagtattattaaaatttttaattttatggaactaagaactatattctatatctgttctttttgttaatgtagttgatgatattggtgataaatatattttactcttattatctacttctgctattataaacgactttggcttttcttctgttattctttctacaaatccgtcttcttctgctagtcttaaaaattgtattgtgtcagagctatacatcgtattttgaagatcgaatattccaataatgtctttaatgggaactactacattttcacctaaatgcaaaaacattatatattcctcccttgatttaaaatttgtccgtttgatacattaaatatcttgactttatcatctaaataatcatttaaatcctcaattccagcacatgttattatagtttgtatatcctttattgatcttaatatatattttttcctatttaaatcaagctccgataaaacatcatctaacaataatactggatattcgcctgtaatctctctaatgatttttaaagatgcaaatttcatagttagaatcgatgttctttgttgtccttgagatccgaaaatcttagtatcaatattatttataaatacgctaaaatcatctctatgaggtcctacagatgttaaccccttttccctatctttttgaatattatcttttagtttttttaaataattatctttaaattttccattctctagattaacagtacaattatatttaaagtttatttcttcttttccagatgtaatttctctatgaattatatcaccgtaaaaatttatcttatttatatattctaacctttttgaaataatataatcagcatatttacttaattgtatatcatatacatctaagatatcttcactaaatgacctgctctttaataaaatgtttctttcgcctaaaactttattatattgtactaaattgaagtaatagtttggatttacctgagataattccatatctaatagtcttcttcttaaacttggtgcttcttttataacttttaaatcttctggagaaaacattactacattaaaaattccaaatagttcacctatcttatttacttttatattgtttacttttatggctttcttaccatctctgagtatatttatatcgatttttttatctaatctatttttccctataagtaaacttatgtaggctgtactattttcccaatttattaattctttatcttttgatgttctgtgtgattttgcaaaagcacaataatatactgattctaaaatatttgtttttccttgagcattatctcccacaaacacattaacattttcagtcaattctacgcttaattttttataattcctataattaagcaaatttatatttttaacatacataaaaatacacctataataattatatcataactaatcaaataactatctctatattatttcaaaatctgaaccttcgaagtttactacatctccaattcttaattttttacctctttgagtacaaacttctccattaacctttatcattctatcttgcacataaatcttagcttctgaacctgagctagcaatagatgcccattttaaaaaagcatctaattttataatttcagtatcaatttttattttattcattttcattatataaatattaaaataatatttatcctcctatctcattagtcttactggcaaaactaaatattttgcattttcattattatgttcttcaataacacatgggcttataccagatgtcattttcataacaacttcattatcctccatgttctttaaaacatctaacagatattttgagttaaatgcaatttctatttcatctccttgcaattttatcgaaatttcatctcttacctttcccaattgagaattagaggttattactaagttatcttgatgtaaatctaattttattaagttagtatttccatccttagccattagagatgctctttctatcgcattttgtagttcttgtctattaacatttacaaatagtttgtgttcttgtggtaataatgatttataatttatgaacttaccttctagtaatctagatattattttagttctttttaaattaaataatatatggttattagtaaatgttatatccacaatctcatctatatcttctagtatctttgatacttcatttaatgtttttcctggaattacaacttctatatcaatatccgtatccaaaaattcactttttatagctagtctatatccatctagagcaactaggtttaagtttttatttctcacttcgaataatattccttgaagaataggtcttgtttcgtcttgagcgatagcaaaagaagtcccttttatcatattttttaatatattttgatttactgatatttttaaattctcattaatttcaggtaactctggaaattcatttgtgttcatataaactacatcaaatatggatttttcacaagttatttttattagctgattttccatagtttctattcttatagttgaattaggtagttttcttattatttctccaaatattttagcatcaataactatacttccttcttccataatagttgcatcaactaatgtttgaatactaacatccatatctgaacctataagagttattgttgaattatttgcatttatataaataccttctaatatgggcattgttgatttacctgttatggctttttgaactattgatataccttctaatattttttgtttttcacatgtaaagatcattgaaaatcctccttattttattcacaagaattaaagatgataattagtagttagataaatatttttatagtaataatagtagtaggggctgttaatttgttgataactagtataatcgctgtaatatcaacaaaatttaattcaaaaatattgtggataaatcagtaacaaaacagactggttatccacaagtataagcataatataactaaaaaaatattatccacaagttattatgtacttattatacagctctgtggattaattctgagtcaatttttttgtaatgtcgttaacagtactttgtaatgaatcatcagttttgagattctcagatattttctcataagcatgtattactgtggtatgatctcttcctccaaattcttctccaattttaggtaaagacatatctgttagctttctacttaaatacattgctatttgccttgggtaagcaacatttctagtccgcctttgagattttaaatcttcaacacgcaaattaaagtaactagaaactacatcttgtattaagtcaatagtcacatgctttccttgctttttagatattatatcttttaatgcttctgtagctaaatctacagtaacttctctgttagttaatgaggagtaagcaattattcttattagtgcgccttcaagttctcttatattagatttaattttagtagcaatgtaccccataacttcatttgctacatttagattttcaacatcagctttcttttttagtattgccattctagtttcgaaatcagggacttgaatatctgctattaagccccattcaaatctagatcgaagcctatcttctaatgttggaatttcttttggcggtctatctgaagataatataatttgtttattcgcatcatgtaacgcattaaatgtatgaaagaattcttcttgagtacgctcttttccggctataaattgtatatcatctataagtaagatatcaacattcctgtatttatttctgaattcttcattcttatcatcttttatagcgtttattaattcattggtaaatttttcagatgagacatatacaactttagcattaggattaccatctaagatgtaatgaccgatagcatgcattaagtgagtctttccaagtccgactccaccatatatgaataacgggttatatgcttttgctggtgattctgcaactgccaaagatgcagcatgagcaaatctattactattacctattacaaaagaattaaaagtatattttggatttaatgtagacgacatttcatcattaactacaatagcttttgatttctgatttgatgaactcttaatttcttctttttcatagatttcagacattataataaattcaattgtatataattttgaacatactgcttttatggaatttgcaactaaatctttatatcttttatctaaaatatcttgagtaaaggaatttggaacgcttatctttagagtattagaagaaatagacagaggttcgcagcttttaatccaagtattaaaactaacttcacttagctcactttttataatatctaaggttttatcccataaatttttaagatcggcatccattcttattcctccaatattgtaataaaaaaatttttataatagttatgtacagtttatcaacaaggatattaacattcatatattatagccaagtatgtatataaatatatcaacatgttaataactatgtgtatatattaaatttatagaaatttaataacaatctgttattaagtgttataaacatgctaagatctaaataaaatcaactataaagcatgtactaacaataaaaataaacaagttatgcacaattttatccacacatgtggataagtttttatattaataagttattcacaacataatatttatgataacataagtaaatactcatattcaataagttatccacaaaaaaatatatataaatatatttatcaacaattattaccaccttgacagaaaaatagtatatctatataatgataaagtaaaatttaaatagcgaagtatagtttttactataaataataaatttaagggggtgcatatgtaatgtttatgacttaccaacctaaaaagagacaaagaaaaaaagaacatggttttagaaaaagaatgagcactcaatcaggaagaaacattcttaagagtagaagacaaaaaggaagaaaaaaattaacagcttaagggcccattagtggccttttttctgcaaatgcagggaaaaaaggagtataaaaatatctatgatttatagattaaagaaaaattttgaatttacaattgtatataaaagaggtaaatcatttgcaaatgagcttctagttatgtacatattaaaaaatagaaggaataaggatagagattttttagcctatagcaaggtaggtatttctgtaagtaaaaaagttgggaatagtgttgttagaagtagatgtaaaagattaataactgaaagctttagattaaattataattatatagtaaagggatatgattttgtttttatagcaagaaatcctcttcaaagtaaaagctactttgaagtagaaagagctatgagaagtttaattaaaaaggcaggcttatataataatgaagaaattactaatacgcctaattaaattttatagaaaatatatttcacctggaagatcttcatgctgtagatttgtgcctacttgttcacaatatgcaatagatgccataaataaatatggagcttttaaaggtagtgcattagcagtttacagaatattaagatgtaatcctttttgtaagggtggatatgatccggttaggtgagatattaggaggtatatattttaatgtttcaagcaatagttaactttatgaaagggatatttgattccctgcatgactttatagttagtatgggaatatcggatgttgggctatcttatgttttggcaatatttatttttacattgattataagaattttaatattaccatttaacattaaggcagcaaagtcatcacaaggaatgcagaaaattcaaccagaagtgaaaaagcttcaggctaagtacaaagacgatcctcaaaaattgaatactgaaactatgaggctatataaggagaataatgttagtgtagctggtggatgccttccatcattattacctctacctatactaatggctctctattgggtatttatggggatacaaggaatagaaggtgcttcattcctatggattcacgatttatttgcaccagataaatattatatattaccagtattagctgcattgtcaacatatataccatcttatttaatgtctaaatcaacaccatcacaaccaggtggaatgaatatgggaagtatgaatttagttatggctggaatgatgggtgttatgtcattgaattttaaatcaatacttgtactttactggataattggtaatttaattcaaacaatacaaacatattttttaaactataggccagcaatgagagagatggatgataagactcaaaaagatgctgtaacagaatcagataaatttgttatggcagtggaagaatctaaaaattcagctagtaaaaagagaaaaaagaaataatcaaaaagtgattttgctttgatattagaggtggtgaattaacagatgaaatcagtagaagtggaaggaaagactgttgaagaagccttaaataaagctttaagtgaacttgatgcaaataaggatatggttgatattgaaattttggatcatggctcaaagggtttatttaatgttataggagttaaaccagcaagaattagagtttctagaaaatataattatattgaagaagcacgaaactttatagttcatatactcaagggaatggaagttgaggcaactattgatattaaagaagagaatgatagcattataattaatttatccggagaaaaaatgggagtgataattggttatagaggagagacattagattctattcaatatttagtttcacttgtagttaataagttacatgaacttcctcataaaaaggttatactagataccgaagattatagaagcaaaagagaggaaactcttaaaggtgttgcaattaaaacagctaatagagttaagaaaacaaaaaaatcatttaaactagagccaatgaatccatacgagagaagaatcattcattctgcacttcaggaagatgcctttgttaatacatatagtgagggcgaggagccgtttagaagggtagtcgttgaattaaagaaagattaaacttaaaaagaaagccataatggctttctttttaagtttataaataaaatttatgattaaaaagagaagttttagctaatataactttgactatttaaattttgttatgtaaaattgataatagttaaaaaggagttttagtttagaaaatattcttctttaaaaagaggaggaaattaaatgaaagaatttgatactatttgtgcgatcgctacaccaatcggagaaggcggagtttcaataataagaatttcaggggagaatgttttaaagattgctagtaagatatttactcctaggaataaatacgatattgaaagcatgaaaacatacactatgaagtatggtaatattgtggatttagagaacaaaaaagagataattgatgaagttattttaagttatatgaaagcgccaagaagctatacgggtgaaaacgtggtagaaataaattgtcatggaggagttatatctactaatagtgtattagatcaggttatcaaagctggtgcaagacttgcagaacctggagaatttactaaaagagcatttttaaatggaagaatagatttgagtcaggccgaagcagttatggatataataactgctaaaacagagttatcgatgaaagccgctatgattcaaagcaaaggggctttatctaaagaaataaatgaattaagagggtatttgctaaacgttttagcgctaattgaatatgcagttgattttacagaggatgatgaggatatcgttgatgacaatttaattttacagattaaagatgggatcgagaatacaaattcaaaaattgaaaccttattgtctaatgcggatgcgggtaaaattgtgagagatggactcaatatagttattgtaggaaaaccaaatgtaggaaaatcttcattacttaatgcattattaagagaaaatagagctatagtaacagatgtcccagggacaactagagatataattgaggaatatataaatcttgatggaataccggttaaaataaccgatacagcaggaataagagatacagaagatgtagtagaaaaaataggtgtggaaaaatcaaaagagaaaattgaagaagcagatctaataatactcatgcttgatgcatctagatatatagatgaagaagacagtagaataattaataaaataaagaatagaaaatatatagtattattaaataagatggatttgaaagatataaaaattcaagaagaaatacttaagaatttaagtaatataataaatatatcagctaaaactggccaaggaatagatattttaaaagatgaagttaaaaagttattctttaatggagagataagctctgaaagcttaataatttctaatgcacgacataagcaagctttatataaatcattagaaaattgtaaaatggctttagataaaattaatgctaatgaatatcttgatttaatatcaatttatataacagcggctatgaaagctttaggagaaataactggagatgaattagaagaagatttattaaacaaaatttttagtgaattttgtgtaggaaagtaggtaaaagtaatggcagtaaattatgatggtggtcaattcgatatagttgttgttggtgcaggtcatgcgggatgtgaagctgcattggcatcagcaagattaggccttaatacattagtatgtacaataaatttagattcaatagcattgatgccttgtaatcctaatatcggtggtactgcaaaaggtcatttagttagggaaattgatgcacttggtggagaaatgggaatcaatattgataatacatttattcagtcaagaatgttgaatacttcaaaaggaccagcagttcactcattgagagctcaagcagataaaaaaagttatcaatttagaatgaagagaattttagaggaacaggaaaatcttaaaataaggcaaattgaggtaactgaacttaatgttgagaatggaaaggtgacaggcgtagttactaaaaatggagctatttttaaatgtaaggcggtaattcttgcaactggtacatatttaaaaggaaaaattataattggtgaagtatcatatagtggcggtcctaatggtttatttccagctaatgacctatcacaatcattattagatttaggagtttctttgaggagattcaaaactggaaccccagctaggataaatagaagatctgtggatttttctaagatgatagaacaaaatggtgatgataatataatacctttttcatttatgagtgaaaatattgaaagggaacaagtatcttgttatttaacctatacaaatgatgaaacacgtaaaataattagagataatataggaagatctccaatttataatgggagtataaaaggcgttggtcctagatattgtccatcaatagaagataaaataatgagatttccagataaaccacaacatcaaatatttattgaacctgaggggcttgacacactagaaatgtatgtaggtggattttcatcatcattaccagaagaagtgcaaattaaaatgcttaaaaccttaccaggacttgaaaatgttgaaatgatgagaactgcatatgcaattgagtatgattcaattgatcctactcaattaaaaccaacattagaatttaaagatattgaaggattatatggtgcaggtcagcttaatggaagttcaggatatgaagaggctggagcacaggggttaattgcaggtataaatgcagcattaaaaattaaagaaaaagaaccactaatactaactagatctgatgcttatataggagttctaatagatgatctagttacaaaagggactaatgaaccttataggatgatgacttcaagagcagaatatagattattattaaggcaggataatgcagattttaggttaactaatttaggatatagagttggattagttacagaggaaagatatgataaatttataaagaggaaacaaaatattgaaaatgaactagaacgattaaagaatttaaaggtaactaataaaaaagaaataaatgaatttttaatatcattaaattcagctgaattaagaaagccaattactttttatgaactgctacaaagacctgaattagattactttgatttaaaacaaatagattcggagagaccagaattacctcatgacgttggagagcaaattaatatattaacaaaatatgaaggatatatacaaagtcagcttgaacaagttgctcaatttaagaaatttgagaagaaattattaccaaaggatattaattatagtgatattaaggggttaagaactgaagcaatacaaaagttaagtgatattaggccaataagcataggtcaggcaacacgtatttcaggagtgtctccagcggacatttcagtattacttatttatcttgaacattattataataaataattttaattattattggaggaattatgaagttttatgatttaatgtctaaatcagcagaagatgttggtttacaactatcgaaagagcagtatgaaaaatttattgattatatgaaacttcttcaagaatggaatgaaaagattaatttaacagctataattgatgatgaagaaataatcaaaaagcattttattgattcaataaaagcatttaaaagagatgaattcaaaattgctagcagtttaatagatgttggtacaggagctggttttccaggtttgcctattgcaataatgagagctgatttgaatgttacactattagattcattgaacaaaagagtgagttttttaaacacagttattaatagaattggagcatctaatgtaacaactatacattctagggctgaagatggagcaaaagatattaagctaagagagaattttgatattgcaacatctagggctgttgcaaatatgagtgtattatctgaattatgcttaccatatgtaaaagttggaggaagttttattgcgctaaaaggtccatcagttgatcaagaaattatagagagcacaaatgcaataaagattttaggtggaaaaatattagaagtttgtgaaattaacattgaagatacagaattaaaacataacttagttgtcgtgaaaaagatagatagatctcctaagggatatccaagaagggcaggattaataagtaaaaatccaattaaatagagatattacataaataattgaaatttgattatgtaagcaggtatatgataaaatattaaggtaggagttaaatagacaaataaggataataaggtaaaatatgtatgtagtattttaataagggatgggttgggaacatgaataatgaaatagtaagtattagcataaataaagtcattccaaatatttatcaaccacgtaaatattttaatgaagaagctatagaagagttatcacaatcaattagagaacatggaataattcaaccaattactgtaagaaggcgtggagaggtctttgaattggtagcaggagagagaagacttagagcagctaagttagctgagttagagacggttccttgcaatattatagatataactgactctgaatctgctcagatagctctacttgaaaatcttcaaagagaagatttaaattacatagaagaagcagaagcttattataatttaataagtgatcataattttacacaagatgaattagcaaaaaagatgggaaagaagcaatcaacaatcgctaataaattaagattgctaaagttaagtagtgaagtcagggaattatgcttaaagaataaattaactgaaagacatgcaagagcattgttaacaattccgactgaagaaatgcaattaagaattgttcaaaaagtaataaaagacggattaaatgttaagaaaacagaagaattaattaacaaagaattgcttaaattggctggagaagaattaaaaaataagaataaaagaaatataagaggtgtattgccggctaaactttatgttaatacaataaaacaagttttgcagaaatttgatattccagctgaatatgcatataaagatgatgatgaatttatagaagtagtagtaaagataccaaaaacaaaaaaataaggggaataattggaagttaaggttttaccaagtattaccttaactttaattatatatacatgttgtaattgaatttctacattttggtcttaacttagggattacataactggaattctaaatgtaaatttattattgcaagtatatattaatcttatatttataaatataggattgtcaatcatatttatacacagaaaattaagaattaatgaaaaatattttattatagaatatattttattaagagttattgttttttagaacataattcttttattataataaaaaagtatatataatattaatatggaaaggggggacgctcttttagggctgtgcttatgaaagtaatttgcatttttaatcaaaaaggtggggttgggaaaacaactactaatataaacttatgtgcatatttagcaatggaaggttatagagtattaactatagacatagatcctcaaggaaatactacgagtggattaggattggataaaagtaatttagacttatccatttacgatgtgttaatttctgatgcaactatgaaggaatctatagtaaggagtgacttagtgcagaacttgtatatatcaccgtcaacgatggaactagctggcgcagaggtggaacttataaatagaagtgatagggaaaatataatgaagaataaattaaaagaaattgaatcagaatatgactatgtgtttatagattgtccaccatctttaggggtattaacaataaatgcattaacatgtgcagattcagtgctaataccaatacaatgcgaattctatgcattggagggagttagtcaattaataaacacaatacaattagtaaaaaaatctcttaataaaaagctagaaatcgaaggcgtcgtaatgacaatgtttgattataggacaaatcttagtaatgaagttttgaaagaagtaaaaaaatattttaagaataaggtatatgaagctacaatatctagaaatgtgaggcttgcagaggcgccaagctttggacttccgataatgttgtatgacgaaaaatgtaagggcgctgaggcgtatgtaaaattaactaaagagtttttagagagacagtaggtgatagaatggcaaagaaattcgccttaggaaaaggattaggcgcgcttataccggaggaatcagataatactgcacaagaaaataatagtttgctcattcctataaataaaattaaaagtgatgaagatcaaccaagaaaattgtttgactcagaaaagatagctgaattagcagagtcaatcaaaacccatggtgttattcaacctttaattttaagagagctaaaggatgatagatacattatagttgctggagagcgcagatggagagcggctaaaatggttggcttaaaagaagtcccagcaataataatggaattaagtgatagagatatattagaaatatcattgatagagaatattcaacgccaagacttaaatccaatagaagaggctttagcatatagaaaattgctaaatgattttaaaatcacacaagaagaattaagtaagagaataggaaaatcaagggttgctattgctaatacaatgagactgatgaatctggatgaacgtgttcaacaatatataattgagagtatcataactgaaggacatggaagagtacttctttcaataaatgataagcagaaacagtatgaaatagctcagcaggtaattgatgaaaaattatccgttagagaattagaaagattaataaaaagaattaatgatgatattgaaaaggaaaaaaataatgaaaatataggagaagtaaatccttattataaagaaattaagaatcagcttcagaactattttggaacaaaggtaaatattttaaacaagaagaacaagggtaaaatagaaattgaatattattcagaggaagatcttcaaagaatactcgacattattaatatgtaatgtttcacgtgaaacaattatgaaaggaatgacacaaaattggatatgctaattagcgcaatgaatgatataatgccatatttattaattggaatggcaataataattatattattatttataatggtagtggtcttatttaaagcagttggaaaagtagaaagcagatacagaaaattaatgaaagggactactaataataatttggaagaaatgttactggaaagattagatagtattgaagatgctaaagaaagatctgataaggctctagaagaatgtaagagattagaagttaagatgaaggattgtgttcaaaaagtagcgattatgagatataaggcattcgagaatgttggtagtgacttgagcttttcgatagctatgctagatgatagaaatgatggagttattttaactggtatatatggaaggcaagaaagtacaacttatgcaaaaccaattgataagggaatatcaagatatgacctttccgaggaagagttatatgttttaaatgaagcagctaataaagaaaataagaattagtagaattgattttagttaagtgggcaccaatagattttggtgctctattttcgtatttaagaatatcacaagctggacttgtggttacggaaagcttttgactgtaggtgaagaaataaatctctgctgcaaaattatagcatgttcgccgacttgaatcatgaactacaaggaggtgcatcttttgtggacattgataatttagagtatagtgaacggaatggtaaatattatatagttttcatgccaaggtttagaaaaaaattatatacaagaagataaagaatgatatatgaaaacacctggattattatgtgaaaaaaatacttgaaattatagaagtgaaagcatttctagattatataatatgtttgtaagtatacaacctaaattaagtgtagtgaaatctagggggtatctgaaaggtagaattcattgatgattttttatggacacacaaaaatgcaagtatagaaatggacaattttctgtaaggatattatgtagatataataggaataagcataaagataataaaagagtatataaaaataaaatatagagaagatatagcgtatgaataaatgaacattgaaggaatatatcgacgcatttacatagataatcaagattgatttccttattgaaaaatagatattatctacaatggtgcagttttgtttaaagaaatttacagttgaataaaaaaacagattacaagctatttctaatgactagaaactttttctatagacctacccgcttgaagtagctttgtaaatatattattttagacttttctaaattcttattagcaacttatattcagtattaatgtgaagaaaatcaatacagtatatttcgcaataagtataatttactaacattatgattagatatctattaatactttttttacttttcacttgatttccatctagccctaagtaagttttgcaatctctaaaaaatggttcaatcgtctaacgaacagctaatatataggctttattttcaagtttgagaagtgttgtaattaatttttgagttaattctatctttataatataatctttatcatagatatcaattgagtatggcagaactaatccgttacacggtagtaaagaaactattatttgaaagaaatctagtaatactagttctatgtttcgaaggagcaagctctgctatgtcggaaattttaaacattataaccttctgatatcatagcattcattatattttctaaattccttaattgacgcgtagttaagtgaaaattaaaatttagttcttttaaaaaattgtatattgatagttcatccgatacaattgtgttttgaagcatttatgtatggctccttgttggcattattgtgtggtaactcaattataacaaggatttgtcataggtgtttttttactttatttagttgtagaattattcaagcatttttacactagtatagttataagtaagtgattatagttatgttagaaaccagaaaactattaaattataatataccacgcatggctagaaagtttttattgttaaaagaaaattagcaaagaaaataaagattgtttcacgtgaaacaatctttattaaaaaataatacaaaatagtattacctgatgacaactatataagtttaaaataaattaataatcatagaaatgagaattgttttgttaaaacaattaagaattaaaagttactaaaattgaatatttacagaagtgctagtagtgctaggcctatctaagctctttaaaataaaataatagatacctctagaaattgaatctgcgagattcataacagtatataatctagtattttgtaaaactaaaaaatcaaatcctccggatacatttacaataccagttatactcatatcaccaacggcaggaaggttcttatttaaagccaaaccaggaagtagaggctttttctgtatgaaaactttacctatattatttatagatcctaaacaagaatcgattgctataatatatggatttataaaattaaaatttatctcatttaatttacttactatattttttgcatgtattggattttcgagtgttccaaatatatgtatattattcttagaaaaatgttttaatttatgtcctactaatgggcctaatgaatctccagtagatctatcacttccaatacaaataaatataattggtctatcttcataaagtattggttgtaattcagtcaataaataatctttgattttagtacaagaagccagtgaagatgagtttacagaaaaactttgatacataagaaaacctccttttattagatttatttccaataaaaagaggttttattcattgtctaaaaataataaatagaatacaaattaaattaataatcacatctaacaagaaaataatataaaaggtatgtattaaggccggtgctaagagcacttgaaatatttgttgttatagattttttgaaattttatttagaaccgtaagcacataattaacttcttccttagttgtaaaataactaatgcttagtctgacagttccggatggataactacctatggtcttgtgtgctaatggagaacaatgcaaaccagatctagtctttattccttcacattctaaataatatcccaattcagaaggatcgagggaattaagatttatagaaatacatgaacttagccttttgccagataaatcaccataaacagttattcctttgatgtttagcaaaccttcgagcatatgttttattaagtagttattatgttcataaattgaatttaaacctactgagtttatgtatttaatagattctgataatccaactatccctggaagattatgagttccgcattcaaacttatcaggtagaaagtctggttgtgataaagaataagaaagacttccagtaccgccatgtattagacttgaacaagagtcattaaatttagagtccaatataaatccaccaattccttgcggacccaataaacttttatgtccagtaaaagctatcgcattagcttttatgtttttcatattgatatccagaacaccggcaccctgagaagaatcaacaatgaaaaaaatattgttttcatcacatattttaccgatgttatataggtcttgtactgagcctgtgacgttagatgcttgagttattacaactagccttgttttattagtaattttcttctttaaatcattggcattgataaaaccttcagaatttgcagctactatatctaattcaatttgaagattctccttacaagagaataatggtctaataacagaattatgttccattgaagatgttattacatgatcaccatgccttaaaatacctttgattaatatgtttaaagatgtagtaacgttgtttgtaaaaataacattactaggggaatcataaccaaaaaaattgcaaattaattctcttgcatcataaaggtatctattactttgaagagaattactgtaatttccacggcctgcattgccacctacatttagcatatagtcacacatggcattaataacttgctttggtttaggaaaagttgttgatgaattatctaagtaaacttccatatcaagtattcacctctaaaaaaataatttgtaagagccccaaataataaatattatacccaaagcaaataggaagtagtccaatattttagttgtattattggccaaatcaggtttgaatttcttaaaacctttacttactaaaatattaagaaagcaaaaccaagttatacttccaattatcattgatgagattgagaatataaaatatatccttccatgatgtctccaaacattgaatatggttccacttaatgcaatccataatgatggagttgttggattgagaaacgttatcaaaaaaccagttaaaaaagcatttgatgaacgtctataaattgatttttctaagttaaggtctggctttttagctgtaaatgatattttattagatataattaaaacaataccagatactatccaaaatagactgtgaaacttaggatttctagtaagtattgtaaaaagacctaggtttataattactatatatgttatatctgcggatacagcaccaagtgatactttaaatccctctttaaaaccttttgatattgaacgactaacagattcaaggcctgagggccccaaaggtatagaggcaacaaaacctgtaaaaaaaccaattaatatagcttttaatatgttaattactgaaaacattatattctccttctaattgcatttctatataattataaaataaaaagatatatttttcactaaatttatgaagtttttatatgaatgtgttcttaacctttataaatttaaaaaaatatatataatattaatataagttataataaagattatataggtggtgtaaatatggattattatataatagtattcaaaaatacatatgatgcaatgtcagcagaaaaaaaattaaaagaattagatctagagtttagaataatgccaactcctacatctataactatgagttgtgggatatgcgtgagaatagataaaaaggcagatatagataacataataaataatgatttgatggaatataaaaatatatactatagaaatgatgaaggatatatactaattaataaataggaagggggattatgtttgtatggtaattacttaatagagttagaggaagatttccaatttttaaaagaattgaaatctaatattaatagtacgctagtagatatcataagtgttaaatcaatcgagctaataataaataaagcacttaaaatagcagttgtaattattataatgtatttttctataaaaataggtaagcatttaataaaaaagtttgttgataagcagattgaaagcaatgcagtgatttctttggattctcaaagggcaaaaactttgggggaagtattgaaaagtgttttaaaatattcagtatattttatggggataacaataataatatcaattgtatttggtggtatgtcatttacgtttgcgagtataggtggaattgcagttggtcttggtgcgcaaagtctaataaaagatttaattaatggattttttattttatttgaaaatcaatttggagtaggagatcatgtaacaataggaagttttaacggaattgtcaaaagtataggaattagagccaccgtgattaaagattttacaggggatatacattcaattccaaatgggtcaataggtggagttacaaatcattcgaggaatgatattaggttcacggtagacatagatatatctccacaggaagatattaaaaaagttattaacgttataagagctgcttgtgacgattttaagagcaaaaacgaagaatatataggtgaatctatagaaataactggggtcatagctcttgaagtatcaaaggttacaataagagtagtagggaatgcaaagccattaatgcagtggaaaatggaaagagagcttagaatgtcaataaagttagctttagataaaaatagaataaatgtatcattggatgagaaacaactagataatgaaaatatagagaaggatggggagtaatggtagaaaactttaatcttggagatgtggttgaaatgaagaagcaacatccatgcggttcaaatcaatttgaaataataagggtaggtgcagatataaaaataaaatgtactggctgtggtagaattgtaatgattcctagagtgaaatttaaaaaggaagcaaaaaaaatagtaattgctgcagaaagttagcaaaataacttgattcattcttttattaatggtataatcattaattgtaatccctgctatgcaaagcatagccgttagtccgaggggaggaggtgaaattaatgagaaagtacgaaactatatttatattaaacccatcattcgatgaagaaactgtaaaagctaacatcgaaaagtttaagggtgttatagaaaatggtggaggaacagtagaaaatgttgatttctggggtaagagaaagcttgcttatgaaatctcaaaagttagtgaaggtttttatactttagttaactttactgctaaccctgaattaccaagagagttagatagaatattcagaatcactgatggtgttataagacatatcattgttaatgaacaagtataaggtggcgttgtaaatgaataaagtagttctaatcggaagattaacaaaagatccagaactaagatttactccaggaagtggagcagcagtaacaaccttaacattagcagttgataaatataatacaaaaactggccaaagagaagcagattttgttcctgtagtagtatggggcaaacaagctgagagtactgctaattacatgagtaaaggtagccaagtggctattagtggtagaatccaaaccagaagttatgatgcgaaagacggaactaagagatatgttacggaagttgtagcagatcaatttggtggagttgaattcctaggaagtaaaggaagcaattcatcaggaaatagttttggtaatagcaatgaatattcagcaccagcgaatgatgcattcagtggtggatttgaagaggatataactccggtagatgacggagatatgcctttctaaaattttaagtaaggagggaatataatgagcagagaagaaggtaacaacggtagaagacctggcggtaaaatgagaagatctagaaaaaaagtttgtgctttttgtgtagataaagctgaatttatcgactataaagatataaataagcttagaaaatatgttacagaaagaggaaagattcttccaagaagaatttctggaacttgtgctaagcaccaaagagaattaacatcttcaattaagagagcaagaaacatagcattattaccatttacaacagaataatggtagtagtaatatcccccctgagaaatcagggggtttttaatataaaaaaatattattattaaatcaatctctcaactttgtggaaaaatatagcaaattgtctataaattcttgcaatactcacaaaaaaaaattaaaataataatacaagggttttgagagaggtgatagactatgagaaaagataattttaatattatgactaacattaagattatagaagatttaaaagcacaacttctttgtataataggagagtttttcagactattgacaaaaggtaacaatgtagcccgtgattctattttagattgtatttcaggagctataattatactatatattctaggtgataagttaggatattcattggtagatatagaccataatataaaatcaaaattagatttaggggtaagagcagaggatcaagttgaaaaagaaggtaaaagcttaagtaagttgaagcattatattagtaacagaagagattaaatattcttaggaggctttttatgaattggataactatgcttaaacgtttgcttaagcctggattactaattacaattttaatactattatttgcatataattatacaggcataggtataattatcctagtaatctattttatagataatttccaccaattaaattattacttggaaaaggaaagtgattttaaccaatttataaaaagtataaataaaggtatatcagagaatgcattaaagtcaatatatccattagtattgataaaagaagatggagaaatagtttggtataataatttatttaacactttaaaatcagatgaagaaaatactgaaaagaatattttaagtatagccagaggtataaatctagatgattttttaaagaatgaaaataatttgcatcaaagatttagcatacaaaataaattatatgatgtatacgctactttaattgaaactaaaaataaaaaaaatctatacttattatcttttaatgacattacgaagctaatagattatgaaaccactcaagagagtgtaatgttaatagaagtagataattttacagaagtaatagataaaaccgatgataacaacagaccgcttttagtagctgaaatagagagaacaataaacacatatgccaataacttaaaagcaatgattaaaagatatgataccaataaatatgtattatcaattcaagataagtatattgaagatgaaataaaacacaagttcaatataatggaagtaatatcaaaaatagataaggggaattcaattgaaattactttatctattggtgttggcagaggtggaatgtctccacttgaaaatcataacaatgctaatatagctaaagagttagcgttaggcagaggtggagatcaagttgttgttaaaactaatgatgacataaagttttttggtggaaattcaaaagaaatagaaaaaagaactaaagtaaaagcaagagttatagctagagctttgagtgaactaattagagagagtagtaaggtttatataataggacacaagaatcctgatatggattgctttggatctgcagtcggattggctagcgtggttaagcaattggggatcgggtgtaaaattatattaaataatgacattactgcaattggatatttcttaaataaattaaacaaggaatctaaatatgatgatttatttatatcagtagaagaggcaaaaagtgatttagatgcccaaacactagtaattattgtggatgttcataataagagttatgttgctgatttatcgctagtagataaggttcaaagaaaagtaataatagatcaccatagaagaagtcctgatatgatagagcatgatatacttaattatatagaagtatatgcctcatctacatcagagatggtaacagaaattattcagtatatggttgataagcctaaattaacaagaacagaagcagaaggtttgcttgcaggtatttttatggatacaaaagggttttcttttaaaactggtgtcagaacttttgatgctgcatcatttttaaaatccttgggagcagatcctatagaaattaaaaagatgtttactgatgacctagaagattatttacttattgctgagactataaaatctgctgaagtaagagataatacagctattgctataacccctaaaaatattgatacagtaattatagcaaaggcagcagatgaattgctaaatatatccggaatatctgtaagctttgttttaggggaagtaaataacgatatatatataagtggaaggtcagtaggcgatattaatgttcaagtagtgctagaagcacttggcggaggaggacatatgaatattgctggcgtaaaaatatcaaataagacaattgaggaagtaattgttgaattaaaagaagtaatgaaaaaatacttaaggataggtgaataagttatgaaagttattttattacaagatgttaaaaagataggtaaaaagggtgatatcattgaggcttcagatgggtatgcaagaaactttttatttccaaggaaattagcacaagaagctagtgatgcaaatatgcacattttgaataataaaaaagaaaatgagcgaaaacaaaagttagcagaacttgaagcagcacaaaaattagctgaagaattaaaaggaaaagaaataaaaattaaagctaagacaggagaaaatggaaagttatttggtgcaattactagtaaagatgttgcagaattaattagagaacagtataagattgaaatagataaaaagaaaattgttatggatacaataaaattagcaggtggatatgaaattgatattaaactatatccagaagttagcactaaaatgaaggtgattattgttccacaagaataaggaggattaattttgaattcatatgatgacgcaagcttattgcaggatattatttcaggaaccttatcattagaatcacaaatcgaggctttattttctataactaagaatgtacttgacaaaggagcttttagggctagaacagttaggtttaaactagataaattcattcaatcatcaaatctctgcgataaagttttcgcactaaatactatattagcagagggaaaagatttaaaggttacacctaaggaagaagaattgcaaaaagccataaatagaacagttaggttaatttcaaatgaactagcaaaaagatatgttcaaaataaaatcgaatctcaagttgaacaatctattatggaaaagcaggaaaagtatatagatgaagttagactttcagttataaacaagcaaaagggttctgaaaataaaaagactatcagcaaattgaataatttaatagaattagatagtagaattactagtaaaaatattatgagctttttaagaccaactgattttaatcaagtagttgggcaagaaagagctataagatcattaatatcaaagctttcatcaccatatccacaacatataatattatatggacctccgggagttggaaaaactacagcagcaagattagctttagatgaggttaaaaaactttcatttactccttttgatgacaaatctaaattcgttgaagttgatggtactacattaagatgggatcctagagaaataacaaacccattgctaggatcagtgcacgatccaatatatcaaggaagtaaaagggatctggctgaggttgggataccagaacctaaaccaggtttagttacacaggcgcatggaggtatactatttatagatgagattggagaattggactctatgcttcaaaacaagctgttgaaggttttagaagataaaagagtagaattttcatcatcatactatgatccggatgatgaaacaatacctaaatatataaaatatctttttgataatggagctccagcagactttgttttaattggcgctacaactaaaagtccaagtgaaattaatccggctttaaggtctagatgtacagaagtgtattttgaacctctttcttcaaaggatgttgtatttatagtagaagatgcagctaagaaattaaaggtaaacttagaagatggggttgctaaaaaaataagtaattatacatttgagggtagaaaagctgtaaatattctgacagacacatatggatatgcgttacaccgatctaaaaaatttgttgataacttagaaataaaattatcagatttagatgaggtaatatcagttggaagatatacaccatatgaaagactaagcaatgtagacaaaagcgaagttgggcatgtgtatggattaggcgttagtggttttttaggatctacaattgaaattgaagctacagtttttgctgcaaagaaaaagggttcaggtatagtaagatttaatgatacagctggaagtatggctaaggattccgtatttaatgctgcttcagtaatccgaagcttaaccgataaagacattaaagattatgatattcatgttaatatagttggtggaggaaaaatagatggaccttcagcaggtgcagctatcaccatttgcataataagttcgttgttaaacaaacctataaggcaagatatggctattacaggagagatatcactcaaaggaaatgtcaaaccagttggaggaatatttgaaaaaatatatggagctagaagaatgggaataaaaactgttttaattccaagtgataataaaaatgaaattcctctaaatactgatgacatagatattagaactgtaggatctataaaagagattatggacattgcccttatttaatttaatgaaataggtctccttaatatgaaggagacttttttttgcaactaagaaatgatagaattagaatgatgatatacaaaagataaagggaaaattaattgtcaattgataattagataggaggaataaaacttggatgcatcagttatgaggagtttgcctcaaagcatagaagcggaacaatcagttataggatctatgatcatcgataagaatgctattgccaaagttctagagagtttagaagaagaggatttttatagagatggtcataaggtaatatataaagctatacaagaaatgtttagaagtgatatagcagtagatttattaacactattagaatatttgaagagttctgatatgcttgagagagctggaggggtaacctatataacagaaataagctcttctgtaccaactactgcaaacttaagcgcatatataaaaattgtttctgataaatctacgttgagaaaacttattaagtcatcaactgcaataatagaagaaagttataataatcaaagtaatgtggaagatgtcgtggatagtgctgaaaagaaaatatttaatatagctgaaaaaagaacatcaaaggatttcgaacctttaagcgatgtattagaaagaggatttgcacaaatagagaaattgttcaacaataagggaacaattactggtgtaggatctggctttactgatctagatgcaaaaacatccggatttcaaagtggagatatgatattaatagcagctagaccttcaatgggtaaaacaacatttgcactaaatattgtagaacacgcagctcttagagaaaataaaagtgttgtagtcttttctctggaaatgtctaaagagcaattggcatataaacttctttgttcagaagcaaacgtagatatgttaagccttagaactggaactttagaagataaggattgggaaaatatagctatggctgcaggtccactttcaaaggcaaaaatttatatagatgatactgctggcgtaactgttatggaaatgagatcaaaatgcagaagacttaaaatggagtatggaatagatctaattgtcatagattatttacagcttatgtctggaggatcaggtagtgataatagacaacaagaagtatctgaaatttcaagatcgattaaagcattagctaaagaaatggaatgtccagtaatagctttatctcagctgtcacgtgcgcctgagcaaagagcggatcataggccgatgttatctgacttaagagaatcaggatctatagagcaagatgccgatattgttatgttcttatatagagatgaatattacaataaagaaactgaagataaaaatatcggtgagtgtataatggctaagcagagaaatggaccggttggaactgttaaactcgcttggcttggtcagtatagtaaattcggcaatttagatttaattcataaggaataaaatttaaataattagtaatactaaattaaaaagatataagaaatttatataaatataaaatttcttatatctttaaatgatgtgaataatatgattatcaatattattaaacagcttttggaattattaattttaaactgcttttattatcatggagtaaaatattacttacatcaacttttgataaataaaaaattctctgaaataaaaattcttttgaattattattaaacataatctttaatattaaaaaatgatttttataagatatttctaatatatgtttactatcatagaatgaatctacatttatgtaataaaaatctgaagattcttcaagttcacatgtaggaagttgttcttcgagctcaagagatagcatggaattaatgaattcttttgggcttattaaacaattattatatactaaacaattatctttcatatatattcctcccttcatatttaattatagtttgtgaagttttaatacaagctatcctatgatagtggtggtttataattaagatattcatataaaatgataaaatttgaataaataacaaaaattttttaatgggggctatgatatgaataaaaaaattggtttcatcggttgtggtaatatgggaagttctatggttggaggtcttattaaatctggatttataaaggctgatgatataatagtatcaaccaagactgagtcttctttaaagcgattagaagaaagtttccaagtgaaaacaactttagatagtacaattgttgcaagagaatctgatgttattattttagctattaaaccttttatgtttaatgaaatgataagtgaaattaaatccgaattaacaacagataaattaattattactatagctgcaggaattacaattagcaatatggaggagtggattaatagtagtgctaaaataattaggacaatgccaaatacgccagcacttgtagggcaagcaatgtcagcagtatgccctaataagaatgtaactaaagacgagctggattattgctttaagatatttgaaggtttcggagaatgtgttcaactagaagaaaaagattttcacgcatttattgcattatgtggatcatcacctgcatatgtgtttatgttcattgaagcaatggcagattcggcagtaagattaggaatacctagggctaaagcttataaaatggcagcacagagtgtcttaggatcatcaaagatggtcttagaaacaggaaaacatccaggagagctaaaggatatggtttgttcacctgctgggactactatagatgcagtagttgaactagagaaattaggttttagaaatagtgttatacaggctatggataaatgtgcagagaaatctaaaagtatgtagtaattgaaaagtggaggtatattaaataattataattatttaatatacctttttttataattttaatcttccgaatcagaattaattaagaggccaaatgatttagatatattatagtaaaattcaaaatcttcttgagcattaaaaaaacaaggaaagtttaaatcataatttccccaaattgttataggtttgttagtaaaataaaaagtgacgaagaaaatttctcttgtatttaaacgaactaggaatggtataagttctttattaacaagtctaaaaaatacaccagtgtgttcatcaaaatttaaataggaggtgaatatatctttatcttcatctgaaaggagatcaaaaagcttgtttctgtcttcagatgaaattttgtttatataaaaatctatataagcgttagaattattcatctcaaaaatatattctattaatttgattagtttattctcaccatcatcaatatcactagctacaagagtaaaatttttgaaagaatataagccatcaagtatattattaaatcttatattaactttagctttaaaggtatcatcatttataggtattagtaatttattcatgtgattcactcccaatgtaattaatattaattaaatagtttatggttgcctatagtattggttatagttaagttggttttaagagaataatatatttattaacataattcttgaagatacttcttgtggataagattgataataatataatgtggataattatataaaacttattctgtgaataattattgcttaagtgaagttgtggataaaatatttattttcagtattatattatctggtagaatcttaatagaaaagcaatacaaataataaaacctacaattgagtttatcattcaattgtaggtcttaatttgaaataggaaatcaaaaacttaaattcatgaatactaaatactagcaacgccgcttctaattgccgcttctttaacagcttcagcaactaaagcttgaacttttagatcaaatgcttttggtattatattatcaggagatagttcaccagccggtatagcatttgctatagcataagcagcagctactttcatatcttcattaatttctgtagcccttacatctaaagcgcctctaaatattcctggaaaggctaatacattgtttatttggttaggataatctgaacgaccagttcccattactgcaattccagcttcttttgcatcttcaggaaaaatttcaggggttggattagccattgcaaatattattccatctttgttcatagttctaaccatgtctttagaaactatatttggggcagaaacaccaataaaaacatctgcaccttttataacatctttaagcgcaccagtttcattatttggattagttatattagctagttcttgcatgtaaatattatgacttaaatctttatctctacttattacgccatctatatcacacattactatatttttaactccagaagaaagtagtaacttacatatggcagttcctgcagacccagcaccatttataattacttttaggctttctagttttttatttactatttttaaggcatttaacagacctgataaaacaactatagccgttccgtgttgatcatcatgaaatactggaatacttaatttctctttcagtcttttttcaacttcgaagcatctaggagctgaaatatcttctagatttattcctccaagagttggcgcgatatttacaactgtattaacaatttcatctatatctttagtatctaaaactataggaaatgcatctacattaccaaattccttaaataaaatactcttaccctccatgacaggtaaagaagcaagtggaccaatgtctccaagtcctagaaccgcagttccatcagaaataacagcaactgtattccatttacgagtatatatataagctttggatgggtctttatgtatctcacgacaaggttctgcaacaccaggtgtatatgcaagacttagatccttagcagtcttaacttcacaggtaggtttgatttcatatttaccttttttttcttcatgaaatttcaaggcttcttcataaatattcattaaaaacactccttaatatgctaaatatattcaaatttacaaaaacatgatcttgatcataacaatataaaacaattatacgaattatttataaaaaaagcaaaaaaatattcgatatgtggttgaccatagaaaagtactttgctactatttaaaaggagaggttaaaataaatttaatgaaactccaaattgataataaaaattaaagttatttatttaaactttatatattaagggaggcaatataaatgtcagcatttattgttttaggagctcaatggggagatgaaggaaaaggaaagatgacagattacttagcagaggaagctaatgtagttgttagatttcaaggtggaaataatgctggtcacacagtagtggttggtgataaagaatacaaattgcgattaataccatctggaattttatacgaagataaattaaatgttataggtaatggagtagttgtagatccaaaggctttatttgaagaaatagaatacttagaaggtgttggagttaaaatatcgcctgaaaagttaatagtaagcgatagagcacagcttataatgccataccataaggtactagataaattaaaagaaaaagctagaggaaaaaatgatataggtactacaggtagaggaatcggaccttgttatacagataaatttgaaagatgtggaatcagagtttgtgatttactgcatgaagatgtttttatagaaaaattaagagaaaatgttgaaatgaaaaatgcttatattactaaagtattaggtggagaagcattaaattttgatgagatactagatgaatacttaggttttgctaagaaattaagaccatttgttcaagatacatcagttaaggtatatgatgcaattaaagcagataagacagttttatttgaaggcgctcaaggaatgctattagatattgattatggtacatatccgtatgtaacatcatctaacacaactgcaggaggcgtttcaagtggttctggtataggacctaatatgattactaatgcagtaggtataacaaaagcatatactacaagagtcggtaaaggaccattcccaacagaattacttggtgaaactggagactggattagagaaaagggacacgaatatggtgtaaatacaggaagatcaagaagatgtggatggcttgatttagttataattaaaactgcagttagagtgagtggattgacatcattagctgttactaagattgatactttagctggtctagaaaaaatcaaagtatgtgttggatataaatttaatgatacagttatagattacttcccagcaagtttagaagatttagcagagtgtgaaccaatttatgaagaatttgatggctgggatgatagtgtagctgatgttagaagttatgatgaattacctgagaatgttaagaagtatttagcaagaatatcagaattcacagggactagaatttctatagttggagttggaccaaagagagatcaaactatgagaatagataatctatagtttagtattatgctcgggtattgactttatgttttgtataaaatataattttattgtagacaataattacataaagttatattaaagaaggtgaaagtatgataactaaagatatgacaattggtgaagtagttagtgcagatcaatctaaagctcaagttttaatgagttttggaatgggatgtgttggatgtccatcagctcaagctgaaactatagcagaagctgcaacagtacatggattaaatctagacgatttattagaagcattaaatagataagataattattttaaaaggattttctttttagggaatccttttttacttattaaaaaatatatttatatcgtttatgttttttatgtgtaattcaatttttgtgattataatagattataagattaaataattcattaacaatattattgataattttttataataataaatataagatatagtaaaggaggggaggagttgtaaatcaaaatagatgccatttagctataatttattcgttaaataaaaatgtttcaaatttagcttgagatttatttttgcattttacaattgttaattatgagtaagaagtttacaaaaaaatatgaaatacattattatgaagtaaattctaatttaagatgtaaattgtcatctataatagattttatatgtgatgtaggcactcaacaatcagaagccttaggtggaggaattgattactgtacgaaaaataactgcgcttgggtattttataaatacgatataaaaatgtatagatatccaatgtttggtgaggtaataagcgtcacaacagaagctataggctttaagaaattctatggattaagaaaatatacaattaatgatgagaataataatgttataggggaagcactagcattattttttctaattaatatagataaaagaaggccaatgcgaatacaagatgaacaatatcatatatatggagtagatggtgatgttgattacgatataagcatggataaaatagaaagaacaaatgatgcacaatactataagcaatttaacataagatacagtgatattgattctaataaccatgttaataatgtcaaatatgttgagtgggcaatggaagctgttcctctcgatataattaataattatactcttaaaagaattaaggtagtatttgagaaagaaacaacatatggggataagatttcatcaactgctgctataaatgtaattgatgaaaatagtttaaaatcatatcatactataaaaaatggtgagggaactgaactaacgctattacaagcagattggaaaaaataataaaggtaaatatagaaaattagctgttgcaagaatctaggtaatattaataattacgacagctaattttatagtattatttttatagataagttaataatttttagctattggcggcggatttagctgctaaatatccagaactccatgcccactgaaggttgaaacctccacaatctccatgcacatctaaaatctctccacagaaataaagatttttaactaacttagattctaaggaaatattatttacttcagatgtatttacaccaccaactgtaacttgtgaattgttaaagccattagtgccaatacatttaaaatcccatcttttaaacttatcaattaatttgctggtagttctccaatcaatactactgcacggtatatgtatatcttttatcccaacatcttttaaaattgtagaaattaattttttatttataaccccaattagggctgttgatatctctctgtgaccaaacatagaaaaatgtgtggtaaagaaactttcaatatcatctttactttctagtggaaacatatctattcttatagttacatttagattttcatagagagctttagaagcataagatgataattgcattataggggggcctgaaattccataatcggtaaaaagtatttcaccaaactctgttcgaataactttattatcaactaaaatagaagcagagccatcaaattttactcctgatagagcttttaaataaggataatctaattttaattgaacaatgccaggaataggctctataatactatgacccaatgacttgcatagtttatagccagatccatcagaacctgttttagtagctgatttcccaccacagcttaaaataagttttttacaagaaaaatttttaaagtcatcattattacttgttaaaataaagttattttttttacttgtagaatcaattttacaatttgtatatagaggtatttgtctatcctctattgccattctgaatatatctattacagaagaggcctgaagagattttggatacatctttccgctttccaattcaattaatggcaatcctagagataaaaatgtgctttcagtatctttaacagtaaagttatctaatgtcgctttaaagaaatcttgattttcactatggaaacacccaaatgggtgagatatatttttattagtaatattacatcttccattgccagttacaagaatttttttaccaattctatcgttgctctcaataattgccacatcaagtccaaaatctttggctattattgcagccattaggccagaggcaccaccgccgacaatcattaaatcgtgataaatcattataacaatcactccctatgtatgttttattgaccatataaaattaaatcacatattttacccagtgctaaaataaactgaatattttaagtataccattaatttattaatcactactaaaataaaaggattcaaatcatattattcaatattttataatactttttaataaattttatcatagtaatattaaggttaaaagaaaggaatactaaaaatgaggtgattttataatggaagtaaaggtaattaatatgaattcgggagatttcgaaagagtatttaaagtgatcagaatgaactttgataatataatggttaattatccgaatatgagtggggtaaagagtttttcttttaatgatgtggaatgtataagtgaaagtgatatagataaatttttaattaacaatagaaatttcttgaaaattaaattaaaaagagggatatcagtacttttttacaatgcactatatgaatcattaaagttagaaattaaagaagaggtaaaaaatctaagtattttaagagataaatataaactgtacaaaagtaaagtatgggaaaaggaaatgctgttatttataaataataaatttcctttagaagttaaagcgtcaggaaaaaattttaaaaagaatggatatagtataaatattaataaaatagagaaagaagattttttagaaatatgttgtggtgaaataaaaaatattgaagagcaaattaatttaaaaaaagatcttttatctagtctgaaggaggctagagattatatttaaggaacctctgaaatgtagatataatgccactttattaaaaataaataatataaaaataaaaaaaatgaaaaaatgtgttgacagggaatctaattttgggtattatagtctatgtggtcagcagcttgaataactcaaggacatctagttaagacatttaagcgaaagacaatatagcatggctccttggtcaagcggttaagacaccaccctttcacggtggtaacaggggttcgattcccctaggagtcaccatttatatctatcttatgggcgcatagctcagctgggagagcacctgccttacaagcagggggtcacaggttcgagccctgttgtgcccaccataagatggctcagtagctcagttggttagagtgccggcctgtcacgccggaggtcgagggttcgagccccttctgagtcgccatttaaaatatgctggcatggctcaacggtagagcagctgacttgtaatcagcaggttgtaggttcgattcctattgccagctccattttaaataaacataacaaaacctaatatggctccttggtcaagcggttaagacaccaccctttcacggtggtaacaggggttcgattcccctaggagtcaccattttatctatcttatgggcgcatagctcagctgggagagcacctgccttacaagcagggggtcacaggttcgagccctgttgtgcccaccataagatggctcagtagctcagttggttagagtgccggcctgtcacgccggaggtcgagggttcgagccccttctgagtcgccatttaaaatatgctggcatggctcaacggtagagcagctgacttgtaatcagcaggttgtaggttcgattcctattgccagctccattttaaataaacataacaaaacttaatatggctccttggtcaagcggttaagacaccaccctttcacggtggtaacaggggttcgattcccctaggagtcaccatttatatctatcttatgggcgcatagctcagctgggagagcacctgccttacaagcagggggtcacaggttcgagccctgttgtgcccaccataagatggctcagtagctcagttggttagagtgccggcctgtcacgccggaggtcgagggttcgagccccttctgagtcgccatcaaagaacaagttcttatagactagaacttgttctttttttattgtttaaaaaattataatcaagtcagatctgtggataaattttgaaggtattataagcacaagttattaaagggaatttaaatataaataagatgttaacacagaataacatagtttgcgaaacagatttttcaaataaatatgatttataatatcaatttgtagtaaaaatgaaaactctaatatgatagtcattaagagaataaatatcatattagagtttagtttatttaaattatctatttttttctaaatttttcttaatccttatatcttcagaataaaatttgcagagcttaaattctccaattagtctagaagcgattcgctcgctatactgctttgttattcctggcaaagttaaattggttgagataagcattttcttattagcaagaattcgcttgttaattatattaaataattcagttactgaaaattcattaaggtgttctgcgcctaaatcatctacaattagtaagtcgcattctagtaataatgactctaagcctgagtcattattgaatcttatttctcttaaatttttaattaactcatcagaggttttataaattactaagaatcccatatctaatacagatttagcaatacaatatgataaatatgttttaccactacctggatttccgtaaaataataagtttgttgatatttctgaaaaactaggaagatagtcttttagtatatattctaaattattctccatgttttttctgggagaatatttttcatctccaagtttatgacttgaaaacaaatttaaatcaaaattatcaaagttattataggatgttgtattttctaattctgaatttttatagtataacttaatgagcttttgtttatagcaagtacattttatattgcctataaagcctgtatctttacatttattgcattgatatcgcaaattcaaatattcaggatcataacctctttcaactaacatttcacatttttttattcttaaatctgttatattttccttataatcatctattgttttttcactatctttagatttaagaattgatactgccatttttaaagataatcgttgaattttattatccaattcaatgatctcaggatatttctttaatatttcttctttcctaagtttcaaatttctagcttcatcttctctaagtttatcatatatttttaaaatttctgtttgataacccttaatcatcgctatcccatcctaaaagttttttttctaatgaatcatagtcatactctctagcctcaaagttattaaatttgagagatgatttatcattattattagtattataagttttttgatacttattattttttgaatttttattatctttaagagctatatcttctaaagttctaatattatttttattccaattacttaagattccgtcgatatacttgaaatctgctctattcaatctctcaaagcatacgtcacaagctttaaatataatttcgtttgaatacttataaataagaagccatttttctattaaatcctgttgaggtttcattatgtctgtattatttatacctaaataagtaagaatttttcttatattaatccacttatcctctgctttttttattaagttttgagcttgctcgatagtggttattttttgatcatgccaagctatagcaaccttttctatatatctagaatcactttttccctttgatatacagtattccattaaaatcagaattaattcagatgaaaaaccgaattccttttgccaatttaagtaaagtgacatttcgtttggcgatagaggtctagctagaagagtttcaatatcctttagcatatctttagtatttgtactatccaaagcttctaataagtcaacttgtttagtagatttggagggttcttcaactaaatctacgaattctacattaaaattacccatcttatctatctgagttagctttatagctccttgatcattccaataattaaatgcattcataatgtctgattctaacaaattaagcgaggaagctagtattgatgagctaacgcctaattcaccagaaatagtatactttagcatcaataaataaacttttacaaattcgcctctagcctgtggcatgtatttttctataaatacattgttaacaggagtgaaccctagagatctattctttaacataaatgtgctcattccgtttactacctacctttcaaagtttttaatatatattataaaaacaaaactctatctaataatattagattagcataatcgtttataatgtaagttatataataacctaatgtatgtaaaataattatagcatattatcaccttaataaagcgaaatattaatcaactaatacttgggattaattacttttatataagatttgagagaagataaagagcatgcatttgtctttataagaaattaactaatttaataaaacaaatgcatgcttctaaatatggataatattcattaaaataaataatcatatgatgagtttatttatatttacaataccttcgccttgaatttgatttgatatctcatcaataggatcacatgcaacctttaataaggaaatcatatctttgaaagttattgacggatttttctcacataataacgcacataatccactaatataggctgtagcaatagatgatcctgtaaaagttttatatggtacttcaagtttatttggataaaccttaattccgttcttttctgaaatatagttattatcagaattcaaagatataatattaacacatgcagcagataaatcaggttttaataatttcccatatggtcctgcagaagaataagtataaggcttcattatggaggtagttgaatttagaccacctatagtgatacagcttggtagcgtagcaattcccataatagaagttttttcactcaggttacttccgctaggaactatcggaattaatccttttgatatagcatacttaaatgtcaaatcaaagcaagagataatgaatgtattatgagttaaaagttcaaaaggcaaacataatacctttatgttattttctttagatatattagataaactttctatggaatataatatatccgaagcaaatcctttaccaagtttatcaaatgccttgtaacagaatagcttacttttattacaaattcctttatacatattatttgatgagataccactgctacacaaaattccggccatggaggtaccatgtccattatcatcataaggatagcgaaagttattaattaaatcttcgaataactctattttagtgctaggggaagttagatcttgatgaggaaatattccactatctacaagtcctattcctactcctgcaccagataaactgtacttttccgaaaagtggattttatttgcagtagtcacgctcattccacacaaaaacaggtattcatccaagtaaatttttttaatttcaggatattcagaaattctatctatacctcttgaatttagttcggcacttataatattagaggattcaataatgtgatgtacagtacctttatatgaactgattttttttactactgaagattgaaaatctttatattgtataagtattctataacttttataagcattttttgatatataatcttttagattatggtctagcttacttttagatgaaaacatatatttctccaaaatattattacttcaatatattatatgaaaaagaattttattgttaataaaaaatgaagggttaaaaaaatttttgttatataattttgattaaatagatgaagagattgtacaaaaaattaaatagtagattgattattaaaaataaatacaagtatgaaacttgaataaaaataataatcaatctactatttaaaaactgtaggtctcccctatgtctataatttttatagctttatcatttaaatttaataatgattcttcagtctcctgaaaattctctaatgaaattttaaaagttttatagtgaattggtatcattgtagggcaagacatcattttaaacatttcataactctgttctggcgtacaatgcatatgcgaaaatctatcaggtttataacaacctacaggcattaatgcaacatcacaggatatattcttaaaattatctgtgagcgctgtatcgcctgcgaagaacactcttttattttctctttcgattaaaaatgaaatactttcatcatcatgtccaaaatagaagcgtctcccatcatgattagcttcgtaagcagtaatttttataaagtcatctttatatacatctccaggatgtaataaaaatacatttttaaaaccaagcagtctagcaatacgggtatatccttttggaacaataaagacagcatctttatttaatttttttagagatgaaaaatttaaatgatccatatgtccatgagatagtagtatatagtctacttttaaatcatttatgtatactggttttttcacaagtctcttaaaatatcctaaggaattggaaaatacagggtcagttataataattttatttgatagattaataattgtggtagcatgaccaaaccaattaattgaattttccataattttatcagattttatttcagcgcttttttttacatattcttttatattgttaattgttaaatggaataaaaaattaatgttagaaaaaagattcaagtcctctccgtcctctcctaatgattccacttaaatattacaataccagcaatcataatagcaatacctaaaaaatgatttaatgaaaatctaagccgttcactgccaaataacccaaaggcatctataagtgcagcagcaagtaattgggatattaatataataccaataccgaaggtaggtcccattgagctaacactttttattacggtaaaggttataacaacccctagtgcgccacctaataaataaagcttgttggaatccttcaaattagaataattaccatcacctaaaaataaaaaaatgataaggcttaagacaagggcaattatctgaactaataatgtagtttcccatactccgattttctcacctagtctggtattaaatacaccttgaatactcatagcaattccagaaattattgcacatattattccaaacataacatcacctcagaattattattcccctaagaatattaaatattataaaaaataaaaatggtgttatgtaattagcatgaatgcattaattaaagtataaccaagttgtctaaatccttaataaattgattttgtatttgagattctgaaaaacctaatgtcaatcctagacttaataggtcttcaaataaagttaagtagtgatctatagatgggaaagcaattaaatcatttatgtcaatatataggtttagaaactgatcacttaaacaatagtcattaggtgccatagatactgcaattaaatctgtatatttatgatcaatacctagtgttaagacttgagaaatacaagttatatacttatcgaatatagcactgatgttaacaggtctagatttttttagtaagtagctaaaacaattagtttcactagctaatgcaccaagagagatttcaaattctaggtttttgcgtactcgcaatttgtgggagtctagctcttcatttatagataaactatcattgtattttttttgtactttaaatagtggctgaatattcatagtgaatcctcctacatttctaataataatattattttacaaaatctttaaaataaatgaaagttcggaaaacgactacaaaaaaatatttttagaaaattcgaaattaagagattatttttaaattaattttactttcaaggaaaatataactatagatttagagtgattttaaaaaatattaaaaaagactatactgaatataaaaattcactacagtcttaaaaacataaactaattggattgtttaacagacgatttattatgatagtaagaacgcttaaactaaaagtctttcaaaacataagattttaggggagtattcttttttaccgtaggaagcttccatatttcaacactcttaattcttaatttaacaaagttatcactattatatatctcagggaaatttagctttacatcttgctttttatagtccttaggaagataacctaaatttgcaagtgaaataaaactatctccaaaagacttaacagtaaatccgttaagttctaatatatcaaaaagcctacgagaaagtctccttatataacctttatcgtctatttttaaatttatactttttgtaggctcaaacaaataaactgaatcacttgcatcaattctaaaacttttataaggtgctataattttatcaacaactggatataatttatccaaatttggattttcaatagatgttaataagacaaaaggcataggtgagtttctatttgctctgaatttttttgacatattcctttgtattggtgatattacttgataggtttcctcatcaaataatgcaactatatagtacttcatgataaacctcacaatctcaatatattgtattaataaaaatcttagtaaattataacacaataaatagaataaaagaatagaagaataattaaatagtaatgaacagtaatgtcaagaataattaggttttcaaggatattttttcaataaaagaaatatttattccagtaatatatgttttaagggatataattacaacaaaaccaaaagaaaaattgtgttgtaacacatatatagttaaaaaagtgttgatggactgaaaaaatgtatttaaataaatttagtttatgatataataattaaagtagattttaattataaaataggttaataatgtaaaataatatatatgataatatagattttaatagatagggtgaattcaatggagagattagttataaacggcggaaacttgctagaaggtactgttgatatcaatggggccaagaatgcagcagtagcaatattaccagcagctataatggcaagtgatggaaaatgcataattgataacataccagatattgaagatgtacactgcttggaaagaatacttagaagcttaggttgcgatattattaagatagataacaatactttagaaatagatagttctaatgtaaataattttgatgcgtgcacggatgatgttagaagaatgagagcttcatattatttcattggagctttattagcacgatttaagaaagcaagagtagttcttccaggaggatgttcaataggggtaagaccaattgaccaacatataaaaggatttgaagctttaggagctgatgtgtttatagagcacggagcagttaatgttaaagctgataagctagtaggcgctaatatattttttgatgtagtttcagtaggagcaacaataaatgttatgattgcggcaacattagcagagggggtaacagtgctagaaaatgtagcaaaggaacctcatgttgttgatgttgcgaatttcttaaattcaatgggagctgacataagaggcgcaggaacagatgtaataagaattaaaggagtagaaagcctaaaaggctgttcttatagcgtaataccagatcaaattgaagctggtacattcatgatagcagctgttgctacaggtggagatgtttatataagaaatgttataccaaagcatttagaatcaattacagctaagcttacagagatgggggcagtgattgaagaaggtgatgattgtattagagttaccgtgaagtcaccacttaagggtgtgaatataaaaaccacaccatatccaggatttccaacggatattcagcaaccaatgtcaacattgctaagtattgtgccgggaagaagcttaattactgaatctatttgggagaataggcataaacacatagatgaattgaaaaaaatgggagccaatattaaagttgaaggcagagttgcgattatagatggagcgcaaaaattgacaggcgcagtagtaaaggcaacagatttaagagcaggtgctgccatggttattgcgggattagttgcagagggaacaactgaaataactagtatagagcatattgatagaggatatcctcatatagaaaataagtttagagctttaggggcagatattaagagaatagaagttgatgaatagtataaattaaaggggaggagattggaatgatattttgttctttatatagtggcagtagcggtaatagtatgtttattgcctcaaataaagctaagatattaattgatgcaggactcccaggtaaaaaaattgatttggcgttgcaagaaattaatgaaaatccaaaagacttgaacggaatttttataactcatgagcatagtgaccatatcaaaggggttggagtactgtctagaaagtatgacattcctatatatgcaaatgctgatacttggtctgctatggaaagcttaattggaaatataaaagagcataacataaaagtaattgataaaagatcatttactgaaatagaagatatgagtattaaagcatttaatattccgcatgatgcagccgcaccaatgggatatacagttagctcaggagaaaaaagcataagtgtagcaactgattttggaacttttacaagagaaatttatgataatataaaagattcagaagttattcttcttgaaagtaatcacgatgtaaatatgcttaagtttggaccatatccatatcctttgaaacgtaggatattgagcgaaataggacatttatctaatgatgattgtgggagtgccatagttgaactatataaaggttcaactaagaaaaagattattttaggtcatttgagtaatactaataatcaaccagatttagcatatcaaactgttttaaacgtgctaaatgaaaatggaattaagctaaaagaggacataatattaactatggcaaacagacataatcctagcagttatatagagatatagtttatttgagcttataatttatagaaatatattatatataatcaatgaagatttaagggaggacttaaaaatgagtttatatacaaattggactgacatggttgttgactatgtaaaaactaagggagaaaatgctttctgggaagaatatagtaaattagaaaaatcaatatataaagatttattagctaatcataaaagtgttaaaaagactacaataaatgaattagctaaagattatgattccacagtagaatttgctatgggatttatggatggtattaatgatagtttaaaaactcaatatgatcttgagactatagatgctgatacagaaatagtacttgatataaatctagaaactttatatttgaatatgctagatgcaaaagcagaatatttatacacattaccacaatgggatggaatattctcagtggaaaaaagaaatgaaatacaaaaacaatacaaggaatctaagatagtaagaaatctagataaggttggaagaaatgatatgtgcccatgtggaagtgggaagaaatataagaaatgttgtggaaaagataaataatatgattacatataagtaaactctatatttagaggagtttactattcaatgtagtaaaaaaccctagtttagatagggtttttttctttattaatggtttcgtgaaaaataacaattcacaaaggtcaatatagttggtataattatgttatacaaggaattgtagtaaataaatagtaatgctatggaagcacaagtacggatttaaaaaatctgtatttagtgctttatttttttattaaaaagtagatataagaataatatatggggggattgctatgagtttaaagcttaaatatctgttgaatagaaatctaaaggaacattcagaaaaagtatttgaaggaatatcaaatggaagaaaaaaggcattagataactggtttaatgacaagtgggcacaattagaaaatattaagaattcacttgtggcattagaagacaatgataatatagtatgtaattatttaattgaaaccgtaaaaaagcacgaggacttttgcgaaatatttgttttagatgagaaaggaatagtatcagtttcttcgtgcaaagagcatattggattagatatgagtgatttacctaatctaaaagcgggattagaaggtaggcctttaatgtatggaccatatattgataaaagaaccctacatactgatataagtaataagaaatttgctgatgatgttacattaatgttttccagtacatgcaaaaatcacagtaatcaaattagaatattatgctgcagaacactagatgatgatatgagcaacgtaattcaagatgaggatactcatatatataaggattctggagataattacttatttatggtgaagactagcagagatattaagcccggaacagcaatatctagaagcagatttgaggataatacatttacgttaggggagaatcttaaagatggagttaaaacaaagagttggggtacagttagaattaaagagcataccgaatttgaaataatttttaatgatccggctacaagtaaattacatcgaggagttgaaaatacaattcgaaatggtgaaaacctagattgttggcctggatatccagattacagacatataatggtgggaggtaaaggaacattaataaccccccgaactgtgatgaggtatggggaatgatgtgtgaaggtgatatagctgagatatataattttcaaagtattaatttaaagatgccaatatctatatcaataatatcagcaattttaattgcagtaaattttatagcaattaaattatcaccgaataatagtatatttacatctatagcaatgtggattatattatcactgttttcgttattaatatctaaaagaatgatttcatcccctttaagtagaacgataaatatattacaagatattgcggaaggcgaaggaaatttaaccaaaagagttgaaaaaatgtcatcagatgaaatcggagagctgtcgcgatggttcaataaattcataaataatcagatgagcatgttatatagagtgaaaagatcagctaaaactacaaaaaaatcagtaaatatagtttctaatataacaagcgaagttaaaaatggaatgggagtcattgaaaatacagtgataactttactggaaaattctaaagaccaaaatctagtattccaaaataccaaaaacaaattttcagatattacagcatctattcaggaaatggatagtcttatattagaagtatcaggtatagttgaaggaactaatgaaagtgcagcatcggcacaaagcatatcaaaagaagtcttgagtaatatggaggatttagaaaagaccatcgagaatacagtagaatctataagtactttacagggatattcacaggagataagtgaagtaattaatgttataagaaatataagtaagcagacacaacttctagcgcttaatgcatcaattgaagctgcaagagcaggagagagtggaaaaggattttctgtagtagcggaagaaatatctaagctagcactagaaacagaaagtgctaccaagtcaataagtaatgtcattaatcaagtccaaaaacagacacaagcaacatttgaatatgcagaagagataaatactaaggtagatatatctacagcgagtgtaaaagaatctattcaatcatttgatcatattaatgatgatgtaaatataatagctaatgcgatgcagtcaatatcagaaataacttcgacccagagccaaagtgttggggatgttatgaataatgtaagcactatggcagataaaatagaacaatctaccgaaaatagttcaaataaaagtgaagaatcactgtctatggttaaaaaaatattattagaaataagacaactaaagcaagcaaccgatgtactggaatattcgtcagataatttaaatgagatggttggatcatttaaattaaagtaaaaaataatataaaatataattaatatcatgcttttgttaatgtaagaggaaattaatagtaagtcttaattattagtgaatttttaatctatcatttggaaacattatttgcacgcagtttttttgatagcatgttagcaaaagcatggtttaataattagaggataatcaagtcaatacaattaaatttctataaagcaaactttttagaacatacatattaaaactgtacaaataatataaagaactttatccatagaattagaataaaatgtggataattttttttatgaactttaaaatgtggattatatttttatatttagagaattatcataccatttgtgtaaataataaaaatatattataattttatatagttgcaagtgcaactatataagttgtaattaggtttatgaatgttgagttattatatataaattctatttttacagctagataaaacatgtataaacagaaaggataaaacatatggaaagtacggataaaaaaagatggttaatattatttactactgtactactgacatttatgtccacacttgatagtagtatagtgaatgtagcacttcctgtaatgtcgcagaggcttgcagtaagtatggcatctatagaatgggtagtaacgagctatttaatagttattgtaggaactattcttatatttggaagattagctgatattaagggtaaaacttcagtttttaaattgggtataattattttcacgattggttcacttttatgtggattatctaattcattagtaatgttagtcttctcgagaatattgcaagcaattggagctgcaggaaccatgtctacaagtcaaggaattataactcaggtttttccaagaaacgaaagaggaagggcgctaggattaaatggaacttttgtagcattaggttcaatgataggtccaccagtaggaggaataattgtatcgattttaagttggcagtatatttttttaataaatgtgcctataggaattttggcattagctttagcaatgaagacacttcctaaaaattctaataattcaaatgaaaaattagatataaaaggtgcaactttatttggatcaactatggtacttttattcagtgctttaacttttggcaaggaaattggatatgacaatataggaatcattatatcatttgttgtctctattatattatttattttatttataattgttgaaaaaagaattgatgaaccattattgaaactagagatatttagtaattcattattttcgctcagtattttttgtgcattcatttcatttgtggcaataagttgttcaaatattatattgccattttacctacaatacgtgatgaaactagctccttcagttactggtgtattaatgatggtatcaccaataattttatcagttgttgctccaatgagtgggtatatatcagatagaataggatctgaagttttaacatttttaggacttattggaactagcctaggtttatttttaatatcaactttaaatgaatattctcacataggtgcattaattgcctttatagcaataatgacactaggaaatgggatgtttcagtcaccaaataattcattagttatgtctacagtagatacaaaaaatttagggattgctggaagtataaatgcgttagttagaaatttaggaatggtttttggaatatcactatcaacaactcttttatacaataggatgagtagtcaaataggatatcatgttacaggatatatagagggaagagatgatatttttgtatatgggatgcaatatgtatatgttgctgcagctataatatgtgcattaggagcggtgttaacagcatacagactatataagacaaaatctagaattaaagttgaagctctataaatgaatagaatgatatctctaattgttgttagtttaaaacttagtataaaatataaatagtattaagaaataaaaactgtagctgagtaaagaatttagctacagtttttatttttagttataatataggtatgcataaaataattaaaggagataacaatgaacataacgataataacagttggtaaaataaaggaaaagtatttaagggatgctatagaagaatattcaaaaagattgggaaggtattgcaaattagatatagttgaattggtggatgaaaaaacaccagataatgcttcagaaaaagaagaagaggtaattaaagagaaagaggggcaaggaatactaaataaaattaaagacaatatgttcgttatagcaatggatttaggtggaaagcaactaacatcagaagaatttgcaggatacatagataacttgggggtaacaggaaatcccaatatagcatttataataggaggaagcctaggaatctcaaaaagtgttttagcaagagctaattataaattatgcttttcaaagatgacatttccacatcagctttttagagtaatgctattagagcaaatttatagaggatttagaataattaaaggtgaaccatatcataagtagacataaaagaaaaataaattaaatcaataaaaaatagtagttacgtaattcgtatctgcttttttttattatagtttatattaatgttaataatagtattgtaaatagcataattataagtgttgatataaatatagaaactttaaatatatcttaaattaaataagggggaatagaaataaagaaaaaccttacaagtaaaaataattgcttttataagataatggaaggaaaagttatattatctttaaaagaggaggagttttaagctttaattgtctattatggaataaaatagataaaataacagttgaaaagtataccttataggtatacaataaatgtatacggtttaggtatacatttaaggaatatgtttgggaatatggttttacagattttatagaatgacattggtgaaaccgtataattaaagggaggtgtatttatgtttttcaaaactacagaacaacatgaaaatttgagaacaaaaataagagaatttgccgaagaggaagttaaacctattgcatttatgttggatcaagaaaataaattcccttcggaagtagttcaaaggctagctgatatgggagtgatgggtattccgtattcaaaagagtatggaggagctggcttagatgtgattagctatgcgatagctgtcgaggaattatcaagagttgatggcgggacaggcgtaatcttatctgcacatacatcattaggaacatatccaattgcagcttttggaaatgaggagcaaaaacaaaaatatttagtaccattagcaaagggtgaaaagcttggagcatttggtttgactgaagaaaatgcaggtagtgatgcaggaggaacagaaacaactgctgtactagaaggagattattatatcttaaatggcgagaaaatatttatcactaatggtggtgaggctgatatttatattgtttttgcagtaactacaccaaacattggtacacgaggtattagtgcatttatcgttgaaaagggatcagaaggttttagttttggtaagcattatgataagatgggaattcgttcatcagctactgcagagcttatttttaatgatgtaaaggtgcctaaggaaaatttattaggtaaagaaggcgatggtttcaaaattgctatgtctacattagatggtggacgtatcggtattgctgcccaagctttaggaatagcacaaggtgcttatgagaatgccttagagtattcaaaagaaagagttcaatttggtaaacctatttgtcagcaacaaataatagcttttaaattagctgatatggctacaaaacttagagcagcaagattccttatttatagtgcagcagagcttaaaggaaatcatgagcactacagcatggaagcagcaatggctaaacaatatgcttctgatgtttgtcttgaaattgtcaatgatgcgcttcaaatctttgggggaagcgggtatcttaaaggtatggaagttgagcgtgcctatagagatgctaaaatatgcactatatatgaaggaactaatgaaatccagcgtgttgttatagccgctaatattataggaaaaatgccaaaaacagagagtgtagcaaaaacttcaagggaacctgcaacaggatatcgtaagaaagtaatttataaagatggcacacctgaagagagagtaaattctcttgtggaagctcttaagaaggatggatatgatttctcagtgggaattcctatagatactccaataagcaaggcagagagagtagttagtgtaggacaaggcataggagaaaaggaaaatatgaatcttatagaaaagcttgcagttcaggctggtgcagcaataggttcttctagaccagtagctgaaactttaaaatatgttccaattgatcgttatgttggtatgtcaggacaaaagtttaaaggaaatctttatattgcatgtggtatttcaggtgcaggtcaacatttaaagggtataaaagatgcttctacaattgttgcaattaatataaaccctaatgcaaagattttcaaaaactcagattacggtattgttggtgatttgatggaaatactacctctacttattgaagctttagacaatggtgaaccaaagaaagaggctccaccaatgaaaaagatgaagagagttattccgaaaaaagtcactccaacttggaaacattatgtatgtaatggatgcggttatgaatatgatcctggagtaggtgatctagaaggtgaagtaaacccaggaacactttttgaaaatttacctgaagagtggacttgcccagcttgtggtgaagaaaaagatatgtttatagaagtttaaaacaggtaataaataaattttttgtttaaaggaggattagctatgtattgtgttagagaagtaactgaagatctttattggatagggggaaatgatcgtcgtctagctctttttgaaaatgttcatcctattccaagaggtgtttcttataattcttatttacttttagatgaaaagacagtgctatttgatactgtagattggtcaatttgcagacaatttcttgagaatattaagggagttttaggagatagagacttagattacatggtcattaaccatatggaacctgatcatgcagcgtgtattgaagaaattgttatccgctatcctaatgtaaagataatatgtactgagaaggcatttttatttatgcatcagttcggtttccaaatagaagataaggtagaacaagtcaaagagggagatactatgtcatttggaaagcataatgttgtatttgtttctgcccctatggtacattggccagaggctatggtaacatatgatactacaaatggagtactgttctcagctgatgcttttggttcatttggtgcattagatggaaagctatttaacgatgaagtaaattttgatcgtgattggattgatgatgctagaaggtattacacaaatattgtaggtaaatatgggcctcatgttcaggctcttttaaaaaaggcaggcactatagatattaagattatctgtccgttacatggaccagtatggcgtaatgattttggatatttacttgataagtacgataaatggagtagctacacacctgaggaaaagggcgtgatgattgtttatggaacaatgtatggtaatacagaggcagcagcaaatgagttagcaacaagattggttaaaaaggggattaccaatgtagttatgtatgatgtttccaaaactcatgtttcgtatctgatttctgaaacatttaaatatagtcacgttgtgttagcatcagttacttataatttaaagatttatccaccaatgctggactatataatggatatgaaggcattaaaccttcaaaaacgtacttttgctattattgaaaatggatcatgggcgcctcaatcaggtaaattaatgcgtgaattattagaagaaatgaaagatatgactattttggataatgaaatttcaattaattctagcatgaaagaaagcgatgaggatttaatggaatctattgctgatagcattattgaatcaatgaaataatacagaaaagatatgaattttaatcaactcgcaaattataataacgagttgattaaaattataataaagataatagcacttaagattagcttgaaggttcataatgttgagacatattattaaaaaatcaattatataggataaagaagttaattcataatatgtatttcaataaaaaaatgaatctgaatgtgttattatccagattcattatagatattaaaaatatggtttcttatttcctatatttaatgggttcttatatgtttaatcctattcttctgttttcgataatctcctctaactcatcagcagctttgattacatcttcttgaacaataagcttaccgcctgttatattaactaaatcttcttttaaaactttagtgacaacttcacttccatctataaaaggagatattgcaacatgtagtggcagacctaatgatagtccaaatgcagcatcggctaatgcttgctcttcaagccattgtggtgctgataatacaaggggaagttgaggtatatctatacccaagttttcagcaagttcagttgctaccatttctaatcttccaatagctagacatggaccaaagtttaatactggtggaatgcctagggatttgcacacatctcttagattatcacctgcaagatcagctgctccaggagacataagaccaacattttcaaggcctccagaagaacatccggctgaaagaactaaaatatctctttttattaattctttagttagctcaacagtaaatacatcatgtcctttagctgttaagttggaacagcctacaacaccagctatccctttgatttttccttttgctattaagtcaataagaccgctccaatttccacctaggaactcttttaaagatccttcactaacaccagttacaacatcattatgtccatgatctttaggaatgtctattgtgacgttatttcttctgttcttataactttctaatgcttcgtaaatgatcttttcactaatttcttcagcgtttctcatatcaaaatttatatattcagcatttttcttcttagcaacatcatctatacagatagtttttacattaaatttctcagctacaggttcaagtcctggtattgtacagttaaattctgagacaattaaatctatagcaccagttgcgagtacggcttcacttgtataattatttccagcatggcctgaaaaaacttcagtataatgctctcctcttaactgtagatcttggcctacgcatgtacagccaactaatctaaagccctttgcacctaatttcattgctctttttgtgacattctcatcaattaatttatcttgaagatgtgcaatatcagaatgctgatgacctgtaatcattatgttgatataatcctcatctattactctaaagccaactttagcttgtctgatttttggagcacctagcataacatcatttaaaaggttagttaacactagaccatatattccagtagcaattccaagttgaagtgaattaagcagcatatctacaggattactatttagatttgttgaagtttttactagagcatcaaaaacttcggattttgcaccgccaggtaaaatatttaattccttccacttatgatatcttggagcataagctaatttttctaccaattccattttttcaaatcttggtttatataaatccctaagaacttcatcagctactttaattgctttggcatttatatctgattcaacaatatcaaagatttcagcaagcttatccaatgtttctgggctttttatttttaaattaccttttccttcaccaatgtctttaaggtttcttgctgtagtttccactacgtgaaggtaacatgcggaacctgctgctatcgctcttaaaaagtttcttgatacgatagtatcagcatccgcaccacatacacctttaggtgatttaggtgttatcttacatggaccattcgagcagagtttgcaacagactccttcttttccgaatttacattttgctttttgtgtttcaactctgttgaatgatgtttctagatcttcttttgatgataaaaattcacataatttacaatctgctgatgtgcacattgacatattgatcatctcctttaattttatatttaatatttaaccaaaagtatactaaagaggtatagttttaagcaaatataaaaggctttcgcctcttatatttacatgtataaagttaccatggatcattctttagtttatcaaagttaaccttttctagttcatttatcattgtattttgaatattgtataaagccttgtgtatagaacagtgaccagctttatttgcactacaagccttgccatcgtaaacacatctggtcacaataattggaccttgtatagcttcaaccacatcttttaaggttatatctttaggctccctagttatagcataaccaccattaacacctctataagactttaatattcctgcttgagttaactttctagttagttttaataaaaatctaagaggaatatttcctttttcagatagagattttgcatcaagtttgttatctaaaccttctttggatagcataagtattattctaaatgcgtaatcagattcttgattaatattcataaaatttactccttaaagtatacccatttggtataatttatcatagtacaattttttgtaattgtcaatgtttaggttattgcgatatcgcaattaaatagaatgaataataatatacattaaaataaaattcatgagtgtcttttaacataatgattataaagggaatactatataagtaaagcaatttatttgaggtgaggcttattatgtttggatcttttataacaatgcttactggaatccgtatactgaaaaatatgaataaaagtttattgggaattattaaatatgaaaagccaatagataaaggaatagagattgccggttatgattatgattcggtacaagatatattttatagtaatatgaatgcatggcaaagaaatatgggatatagtagattgtatgatgaagcatcagcaccttttggaatgatagtagattgtgaaccaatctattttaaatataataatagaatatggttaatcgaattatggaaaggtcaatacgatttgaatactggatgtgaagtcggtgtgtatacagccgaaaagcctatattaaacttaccagaagtatataagtatatgttttataattgcgctagcgatgaagatagattaacaatctctctttcgctaaaaaagaatggaaaaacacttttcgcgctagatgataagcattggtggttagcaggctttaaacttggtgaatattcagagccttctgaattagtgatgtatttaaatattactttaaaggatgaagaaatgtgcagttcctttgtagaagcaataaaaaagataggatatgaagaaaataaggagtttattgtaaatggaaatactgtaggtttaacatttgataaaccgcacactactcaacctattacaaggacagagcagactgataagatcatacaaatgaaaaataaactgttatgcgataaatataatgatattactagagtatatagtaatttaacagataaaataaatgcaattcagaaacaggcaccagaaatctattcagaaatagtagataaagcagtattgagaaaatatttgagaagcatgaagaatactgaaactgagtaacgtaatattaggaaggcagaatatatatcctgcctttacgtttatattgagtcatagcagttataactgccattggctctttttttctcagcattcttacttatataagaaccttctataactttattatatccttttttggatacaatagatttaatataatctagatgaggacatctatcataatgataattatcatttgtcatgcaagatgataaatgtatcacaacatcttctttatttatgttattttttaacttaagtttttttgagagatgttctaatttagtagcaatactttttccacagcatcctccacaggtaaaggaaatatatctagttgattcgttataatttttaaaaacgtcatctctgttgtaaaaggcatttgtgcaggcaaatccactacaacggttatgagaaatgtcgcactggataataactacatatttttcatccattaaattttatccccctttttaaataaattattagtaactgtatacataagttgtatataaaacaattatataattaagtatatctcaataaaagtatatataagatattaaatataatttagtataagtaacaaaataaaagcattatacattggtaaaaaaagttgaataaattataaaaaaaggatatgcagcgttaaattatctactacagatcctttttataaataaataatattaatttatgcgaataatgcgacaaatactaaagttaaagtacttacaagttttataagtacatggagtgatggtccagcagtatctttaaatggatcaccaactgtatcaccgacgacactagctctgtgggcttcggaatttttaccaccgtgctctcctaattctataagcttcttagcattgtcccatgcaccaccaccattatttaagaagagagccattataacaccagaaatggttgctatcattaggaatccagcagcagcttcttttcctagaagaactccaacgattataggggcagaaattactatgattccaggaagaaccatctcctttagagcaccttttgtaactatatcaacacagcgagcataatcaggtttcgatgttccctccattattcctggtatttctttaaattgttgtctaacttcaagtattacatattgagcagccttaccaacagctctaatagctgtagagctaaatagaaatactatcatagctcctataaagccacctataaatacttcaggtttacctatatcaactgaaaaccatgaatctaaaggttttccaagaagttttttaacttcatctaggtatgcagagaataatagaaaagtagcgagtgcagctgaacctacggcgtacccctttgttaatgcttttgtagtattaccgcatgcgtctaatctatcagttatatttctaatttcttcgggagccccggacatttctgtaattccaccagcattatcagtaattggaccaaatgtatccatggcaagaatatatgtgcaggttgaaagcattcccatggttgcaattgctgtaccatacaaacctgcatttgcaacattaggcaatgccatttcgcttaatctataagatataaatatacaaatagatatacaaacaacaggaagtgcagttgattccataccaactgataatccagttattatattagttccagctccagttttagaagcagtagctatctctttaacaggtttatgggttattgaagtataataatcagttaaaactacaaatacatagctaagcagtattccagcaactgcacatccatatagatagatatagtttacttgcccacctgttgtaagtgaaccgcttaacatatctttaactacgaaaaataatattactaaattaattatggaagttataacaaatccaccttttaaagctttcataggatcatcattatcattcttaactttaacagcaaagatacctattattgaagcgatgataccaagggcacgagcaacaagcggaaatagtattcctttccatccaaatatagggtaaagtccaacgcctagaatcatagcacctatattctcagcggctgtagattcgaataagtccgcacctctaccagcacaatcacctacattatcaccaacaagatcagcaatgacagcaggatttctagggtcatcttcagggataccagcttcaacctttccgacgagatcagcaccaacatcggcagcctttgtatatatgcctccaccaagttgagcaaataacgcgacgaaggaagcaccaaacccaaatccaactataagagagggggcttctttaattaaagtatcgtttccagaaatacctccatagataagaaatagggacgctacacctaaaagagatagggaagtaacggctagtccagtaacagcaccacctttaagagctatttgaagagcattgtttaatcccttttttgcgccagcagcagctcttacattagaattgacagccatatacataccaatatagccagataaagctgagcagaatgcgcctgttataaaagctatacctgtatgtaaagatatagatatggcagagcttggaccttttgatgcattgccgaaatagttagaaagtatgattaaaaataaagcaacaatggataaaacaaagatggttttatattgtcttttaatgaatgccatagcaccttccttaatgtaagttgatatttcttgcatttggctagtgcctttgtcttgagaaaatgtatacctgaccaaataaatgattgctataagtgaaataattataacactataaataagcataaaatatggtaccatttaaaacatcccctttattttttatataaatttgttatacatatatattatacaacaaaatattcagaaaattcaaaaattttcaactttttctataatatatattatgcttaagcataataaaataagcaaagtaaatatatatttatagaaagtttggagaaacctctaaaatatatattaccttgcttagtagttagtaataaaatcatagtattttaatttatagtattatctatcattgttaagtgtaatgaattttaagtttagaacttaggatttatttcatccctttgaattcttcgtaaatcttttagtcttagatgagttttttctctaattgcactccagtgttctccatcaatcatcattttttttgcctcattttttagagattctttttcttcgtagctcataaattataacctccttttatttcatttatacaaatttagtttatcattaataaaattatctattcgtcgtttataaaatttaatataatatgaaattcaattgaattttacattatggtatttatggaatgttgaagcctactattgctatcattacaaactagtgtaatgatttgactagaatgtatattaattaactgaatgtataagtcaagaagaataatttataatgttgaaaataaaaaaatttatataaaaagcaaactaatagtttcataaacgatataaatcttatggttgaaaatggaaacttggtaagcagtgaagcagatagagagtttagtaatacattaatagatcttatattagataaagaagtaattggtagtggtgaaatatatagatcaaataaaacatagcgattatattcataaaaacaaaggaaatattggtgttatatttagagatgaaggtttttatgaaagatttacagtagaagaatatatgagatattacacagaaataattgactcaaagtctaattacagagaaataatgttaaagttctcattgctagagattgcagataagtagttaatatgctaacatacttcattatgggaatgaagattccttacacgggacattttattattataacaacattagtagttatatggtttatataacctggatggtaataggaattttagcagaaaatcaggctagtgcagaaatcataggaatgccgtttttcatggttatatttttagcgggtactttagcaaaaatgaataatatagccggaatggcagctaattttttacctaactataacatgcaagtattaccaggcagaatttttactaatgaacctttaaatataaattttgcgtataatatattagtaattctattgtggattataattggtgctggaatttttgtttatgcttataagaaaaagactgattcgatcatcagtctttttttaatagtaacttaatttgaatagttattcaccaagatatgcactcttaatactttcatcattaagaagaacttgggcattacctgattttactatattaccggtttcaagaacataagctctatgtgcaatggcaagggccatatttgcattttgctcaactaaaagtatagttgttcctgatttattaatttcaacaattgtatcaaaaatatctttaaccacaagaggtgcaagccccattgaaggctcatctaatataagcatttcaggtctgttcataagagcccttccgattgcaagcatttgctgttcaccaccagaaagagtaccagcttgttgctttattctttctttaagtcttggaaacttagcaaataccatttccatgtcttttttaatttctgctttatcgtttcttaaataagcacctagttctagattttctaagaccgatagctgaggaaaaactcttcttccttctggtacatgggaaagacctagagaaactattttattagctgcaaccttatttaattcagagcccttaaaagtgaccgtaccagattttattggttcaaggcctgatatagctctaagagtagaagttttgccagcaccgttggcgcctattaatgtcactatttcaccctgttttacttcaagggaaatgtcccttagtgcatgaattacaccataatatagattaatattttctacctttagcatttttaagccccctctcctagataagcttcaattaccttaggattattttttatttcctctggagtgccttcagcaatcttttttccgtaatcaaggactgctattttatcacagattcccataacaagtttcatatcatgctcaattaaaagaattgatatattaaacttatctttaatccaatctataagcttggtaagttctacagtttcctgaggattcataccagcagcaggttcatctaataatagaagagatggctttgcagctaaggctcttactatctcaagttttctttgttcgccataagggagattgctagctaactcatctttttttccatcgagagaaaagacttttaatagttcaatacttttatctataatttcagcttctgttttcctaaatttaggagttctaaagatggaatcaaatatagaataatttattctatagttaaaacttactttaacattatcaagaacagaaagatgagaaaatagacgtatattttgaaaagttctggctattttcttttgtgtaatattatagggtttaagaccttgaatcttttctccaagataagatatagtaccttcagttggagtataaacaccagttaacatgttaaatacagtagtcttaccagcgccattaggtccaataagcccgacaatttctttttcatttattgttagattaaaatctgacactgcctttaatccaccgaatacaattgataaattttgaacttctagcattgaattaagcctcctctctatcatctgattttttccttggtattaatttaccaaagattttaagagaaatttctttatctccgaataatccttcaggtctgaatatcataagtagtattaaagctaatggatatataaccattctgaaatcgcccatacttctcaaaagctctggtaagaaagtcagcattatagctgaaataattgatccagacaaagatcccataccaccaaatacaacaaaagttagatagtcaattgatttgttaaaatcgaaaagatctggttttatatatccagaatagtgagcataaagtccaccagcaagccctgcaaaaaaggcagctataacaaatgccatcattttgtattttaatgcattgattcccatagattcagcggctatttcattttcacgaatagaaagcattgctctaccctgggacgagttaattatattttttattatgactatactagctatcatgaatatgaaagcaactgtaaaagttgtttttgttgggatgccggtaagtccacgtgcaccaccaactgtatcaatattcataattactatttggataatttggcaaaaggctaaggttgttattgcaaaatagtcacctgtaagcttcagtgtaggatatccaactaatgccgctaatatacatgcaaccacagcaccaataagtattgaagcaacaaacggcatatgcgctttttgtgttattatagctgatacatatgcacctatggacataaatccagcatgtcctaaacataattgaccagtaaatccaacaattagatttagggatacggctaaaataacatttattaaagcgaaagtaatgattcctttgtaatatgaattaataacctttgcacttattaagccaaatagtactccatatgttattaaaactccaacaattatacaaatattttttttattaaataaattcttcataattaacacctacactttcacattggtctttttacctaatagaccagaaggcttaattaaaagtattataattaaaattgcaaatactattgcatctgagaagttagttgaaatataagctttagcaaaagtttcaagtaatcctatagcaattccaccaacaagggctccaggtatacttccaattccaccaagtactgcagcaacaaaagctttaagtccaggcatagctcccatataaggagtgatactagggtaagatattgcaactaaaactccagctataccagctaaggctgaacctattgcaaaagtaagggaaatagtattattaacatttatccccataagagaagctgcttccatatcttgagaagaggctctcatggcttttccaactttagttttataaacaataaattgtagtaaaacaactagaaaagcagaaactccaaacattaatattgtctttatatcaatttgaatagttcctatattaatactcccagcattaattaaatccggaaatggttttggattagatccaactaataatctcatagcattctgtaggaataaagaaacaccaatagctgtaataagcaaagcaattcttggagaatttcttaaaggcttataagcaattttctctataattattccagataatgctgaaactgccatagcaactaataatgttggaattaatggcaattttaatgttgaagcacaatagaagcctgaaaaggctcctatcatataaatctcaccatgagcaaaatttattaactgtattattccatataccattgtatatcctaatgctaggagggcatatacgctacctaacgctaaaccgttaatgatttgttgtaaaaattccattgtatattcctcccttttttaatgattaaggattaactttatcagctaaaacttttttatctccatcaactttaataatagcagcactctttatagcgcttctatcactaccaaatttgatgtttccagtaacactgttcatttccattgaagccaaagcatctttaatagcagcaccgtctgtctttccggccttttctattgctttaactaatattttagatgtgtcatatgaaagagcagcaaaagaatcgggttctttgttatattcctttttatatgattcaacaaatttctttacattttcatctgagtctccagagtagtagtgattgatatataatgcaccatctacagcttttccaccaattttagctaattcttctgactcccatccgtctccaccaaggaattgagaagttattcccatatctctagcttgtttagcaataagaccaacaacattatagtaatcaggtaatacgattatatctggatttaagctcttaatttttgttaattgagccttaaagtcagtatctttatcattataagttaagaattcaccaacttgtccaccagcactttcaaattttgatttaaagctatcggctattccttttgaataatctgatccagagttatataaaactgcagctgttttctttcctaatttttcactagcatattttgcaagaacctctccttggaatgaatctacaaaacagcctctaaacatataatctccaccaactttagttattgttggttctgtagctgttggagtaatcattggaatttgttttgatgtagcatttggtgctactgcaagtgttgcacctgatgtaacaggtcctaaaattgcgcttaccttttcatcatcaacaagtttattgaaagcttgcattgatgagtttggatcagcttgatcatcttcaaaaacaaatttaattttttttccattgattccgcctgcatcgttaacttctttttctaataattgagcaccttcttttactgaaactccataagtagatgcagcaccagataatggtccaatagcaccgattttgatggtatctccgttatttccatctccagctgaattcccgctacaaccagcaagaagagtaatagccatagcagaggctaagattcctgatagtaaactttttttcatatatttatcccccttttaactttaaaaaataatattaaaataataattaattttataatactttgataaaatgctataaagttatcgtatatattgttgatataataacatataggagtaattattacaagattgatatttaatattttatataaaaaataataaaataattataaaaacgttatcatgatttataaattaatcaaaaataatgttatgttgagtaaagttataggtttaaaaagtgtgagtgttttcaaaatgttctcgatttaaggatgattctaatttttgaataatagcagactaagattgtgatttataaataatattaaataagtaagaaggttgatttattgatatatatagacagttattgttgaaaagaataatattaatacttagattatatttaaagtgaagatggtgaattggttgaataaaaaaataataaaattaaattgcaataattataaaaagtatttttactatattaagtatcctgtatttgaagaagatttatgtaagttagagatgaaatgtctttttggtaaaacaccaagtgagaagtatttgttttcagatttttatattagtgcatcaaggagtccgtttataaaagaaatgatttcagtagtatatgaagaagattctttagaacaaataatagacaacatcataaaagataagctagcttataacgagtttaaggtctgttacttaagaacagaatatagtgatatagattatgaagaacgtcttagaagtcttagccagataggatttgtaataacaggagagcctgaaattcacaatcctaaagttatccttggagttacacgaatttgtggaaaatggatatttggaatgtacgagaaaaacgattataagtggcatattcatgataataagccgtattcatattcaaattctttaagcgttagggtagctagagcactagttaatatagcagttaaaaacaatttagaatgcaaattaatagacccatgttgtggagtaggaacagttattcttgaagcgctttcaatggaaattgatgttgtaggatgtgagattaataaaagtatcgcagaaaatgccaagaagaacttggagttttacggatatgagaatgtagtgactaacggagatatgaatgagattgaagagaaatatgatactgctatcatagatttaccatatggactgtttactccaactaccatagaagaacaaacatctctaattagaagtgcacgcagaataagtactagattagtcatagttacatttgaagagatggatgattgtattattgatgcgggttttaaaatagttgataaatcatatgtatgcaaaggtaagtttaagagatatataaatatttgtgagtagaaagttataaatttaatatgaagaaaattttagattgatttctgaaaatattcttattttgaaggtatttttagaagcctagtctatgtattttagccattaattcttatttattaacaaattccggattattgtttcatcataatactatattcttatattttaaattagctaattaagttaagaattattgtatggatacatttgcgtttgtatccatacatattttattatatgagtaacttagaaaaaagggggatttatgtattatggaaagagggacaataaatagaaatcttgctcaaatgttaaaaggtggagttattatggatgtaactaataaagatgaagctataatagcagagaaagctggggcatgtgcggtaatggcgcttgaaagagttccttccgacataagaaaggaaggtggagtagctagaatgtcggatcctaaaatgataagggaaatacaagaggcggtctcaattcctgtaatggccaaagttagaataggacattttgtagaagcacaaattttggaagcattaaatattgactttatagatgaaagtgaagtgcttacaccagcagatgataaatatcatataaataaagaagattttagtgtcccatttgtatgtggtgcaactaatattggtgaggcattaagaagaataggtgaaggcgcatcgatgataagaaccaagggagaagcaggaactggagatgtagtaaatgctgttacccatatgagaacaatgaatgatcaaattaaagagatacaagaagcatcaaaagaagaacttatgactatagcaaaaaattatggagcaccatatgaattagttaaatatgtgtgggaaaatggtaagcttccagtagttaattttgcagcaggtggaattgcaacaccagcagatgctgcacttatgatgcaattaggcagtgaaggtgtatttgtaggatcgggtatatttaaatctgataatccagaaaaaagagctagagcaatagttcttgcaaccacatattataataatcctgaaaaattagcagaagtttcagaagatttaggtggtgctatgagtggtataaattcaactgaagtagctacaaagtatgctgaaagaggatggtaaaatgaaggttggggttttatcatttcaaggtggggttattgaacatttaaatcaaataagggcattaggacatactggtgttgaagtgaaaaaggaaaaagatttagatgatattgatgccataatacttccaggtggagaaagtactactattggcaaacttcttaagataacaggattaataaaatcattaaaagaaaaaatagaaagtggactccctacatggggaacatgtgcaggtatgatactactagcaaatgaagtagagggtcaagaagaaaaatatcttcaacttatggatataaaagtgaaaagaaatgcatttggaactcaaatagatagttttaagactcataaagtaatagaaaaaatatcaaaggatgagatggaacttgtctttattagagctccatacataacagaggtaaaggataatgtaagaatattatgtaaggtagacgacaagatagtggctgctagacaggataatattatagttacatcctttcatccagaattaacaaatgatgtgacatttctaaattattttctaaagagtaaatggatgaaataatattaaatataaataaaatattaaggctgataggaaattgctaaacagtatactttagaaaataatttctatgtatactgtttggcagtttctatttacattaattaaactaatttattgaggttgggggaagaaaatctaataaaagcataagtaaacttatgtagcataaaattatatatagttatatgaatgtggtgttaaatgtaggaccatatacctatttactaagtaagaaataggtaactatgcctagtgtatcaatagtagaaagtagaaggaagatggaggctagtggaggttttaaagtttaaattatataaacaatgatttttgttggaatggctaaggggctatgtgttaagataaaacacgtcgctaagagacataaacaaaacaacttaagactgaaaagattttaataaagaagaaattaaaagttttctacgaaagttgttgacaatgtcgaatggtgatgatatgatgaaatcctcgctaagagatgtaagattaataacttaaagctaatagaactactgaaaaatgagttcaaaaagtttctttaaaagttgttgacaagcttcgaaagcggtgatatactgagtaagctgtcagaaacgacagataacaacaaaacattacaacagtagttgtaagaaagaaaaattggtctttgaaaattgaacagaataacataaatacatttaagtaaaccagcaatttttatttgagtaagctaagattaaactttttattgagagtttgatcctggctcaggacgaacgctggcggcgtgcttaacacatgcaagtcgagcgatgaagctccttcgggagcggattagcggcggacgggtgagtaacacgtgggtaacctgcctcatagaggggaatagcctttcgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgctaaaccgtgaggtggagccaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgtaagcgaggcagcgacctaaggtagggtcagcgattggggtgaagtcgtaacaaggtagccgtaggagaacctgcggctggatcacctcctttctatggagaaatctagatcagcatgatgtctgactagtacagatacattattatgtatcaaaatataaaatacttgctcaaaggttacttaagtatttgttctgttcaattttgaaagactaagtctttcaatgttctttgaaaattgcacatagatttaatgtatataaaatacaacaaagccaagaataaatattctttgtgatatgactaataattaggtcaagctacaaagggcgcatggtgaatgccttggcatcaggagccgatgaaggacgcgataagctgcgataagcttcgggtagacgcacatagtcagagatccgaagatttccgaatgaggaaactcacatgggaaaccccatgtatcataaagtgaatacatagctttatgaaggtatacccagggaactgaaacatctaagtacctggaggaagagaaagaaaaatcgattttcttagtagcggcgagcgaaaaggaaagagcccaaaccagagatttatctctggggttgcggacagaacataacgagaaatcatagttaattgaacacaactggaaagttggaccacagtgggtaatagtcccgtaagtgaaaactatgataatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcagagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcggaaaatgtgagtagtggaggtagagcactgaataggctagggggcatagcgcttaccgaaccttatcaaactccgaatgccacatactatcagtccggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcacgctatttcgtgagcggtagaggagcgtcgtaatcgggctgaagtcgtaccgtaaggagcggtggactgattacgagtgagaatgttggcattagtagcgagatgtaggcgagaatcctacaggccgaatatctaaggtttcctgagtaaagtttgtcttctcagggttagtcgggacctaaggcgaggccgaaaggcgtagtcgatggacaattggttgatattccaataccactataatcgtattatcgatggtgtgacggagaaggataggatgtgctagctattggatgctagtctaagcgtttagggagttgggattggcaaatccgttccaacaattctgaggcgtgatggggaaggttcacggaaccgaagtatctgattccatgcttccaagaaaagcatctagaaagagaagtagtgcccgtaccgcaaaccgacacaggtagatgaggagagaatcctaaggccgacggaagaattgcagttaaggaactaggcaaattgaccccgtaacttcgggagaaggggtgcctgagaaatcaggccgcagagaataggcacaagcaactgtttaacaaaaacacaggtctctgctaaagcgaaagctgatgtataggggctgacgcctgcccggtgctggaaggttaaggggaacacttagtggtaacgcgaaggtgtgaacttaagccccagtaaacggcggccgtaactataacggtcctaaggtagcgaaattccttgtcaggtaagttctgacccgcacgaatggcgtaatgacttgtgcactgtctcaactgcaaatccggcgaagttgtagtgcgagtgaagatgctcgctacccgcgattggacggaaagaccccgtagagctttactgtagcttagcattgaatttcggtattgtctgtacaggataggtgggagactgggaaactagggcgtcagccttggtggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgaagagtgtaaaggcagaagggagcctgactgcgacacctacaagtggagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtatggtaacatatttagctgactgatactaataggtcgagggcttgaccaatatagtcaagttgtaaatacattaaagaaactgtgtgcaattttgaaagaacaaagttttttcaaattgaagatctcgtgatgatggcatagaggtaacactccttcccattccgaacaggaaagttaaggtctatagcgccgatggtactgcatgggagactgtgtggcagagtaggacgttgcgaggtaagcaaaaaagatagttgtaataactatctttttttattttataatatttaggaatggtaagatgataagtttcgccgctgtatagctggattatttaatgccgtatttctaaaaaattcaataagtatgacgattttgtataactcatttctctaaatcattacgaaagagcttattaattcaatgtattcttaattctacaactgaatttctatcctaagcacatatttaagaccgtatatttttacgataagccttttttgatagagttcattccttatataacattaatatctattctgaacaacaaagtagttagtgagagattaacaactttgcagactaatcttattataatatttcatattaactttatagtttaattttttatgattaaaaactcatttagtagagcatattttctgttattatatgaaaaagtttttatgtttgatgaaattttatgtatccaggggtaattggatcctttcatgatcataagatcttttattattttgaacttaatttcttattaataaagatatttagaattattaggaatgagataattaggctaaaaaacatatataaatgtaatagattgaaccaaattggagtgacaactattgctagcgtatcagtatgtataaaatctagaataatgacgtattgtaaagaaaaatgaaaataatcgcatttagtaataggaaagcaaataatatgaaaatatcagagatgttaagataaaacacgtcgctaagagacataaacaaaacaacttaaaaggaaaaagattttctaggaaagttgttgacaatgtcgaatggtgatgatatgataaaatcctcgctaagagatgcaaaattaataacttaaagctaatagaactactgaaaaatgagttcaaaaagtttttttaaaaagttattgacaagcttcgaaagcggtgatatactgagtaagctgtcagaaacgacagataacaacaaaacattacaacagtagttgtaagaaagaaaaattggtctttgaaaattgaacagaatgatataaatacatttaagtaaaccagcaatttttatttgagtaagctaagattaaactttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatggggaaaccctgatgcagcaacgccgcgtgagtgatgacggtcttcggattgtaaagctctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgctaaaccgcgaggtggagccaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgtaagcgggcagcgacctaaggtagggtcagcgattggggtgaagtcgtaacaaggtagccgtaggagaacctgcggctggatcacctcctttctatggagaaatctagatcagcatgatgtctgactagtacagatacattattatgtatcaaaatataaaatacttgctcaaaggttacttaagtatttgttctgttcaattttgaaagactaagtctttcaatgttctttgaaaattgcacatagatttaatgtatataaaatacaacaaagccaagaataaatattctttgtgatatgactaataattaggtcaagctacaaagggcgcatggtgaatgccttggcatcaggagccgatgaaggacgcgataagctgcgataagcttcgggtagacgcacatagtcagagatccgaagatttccgaatgaggaaactcacatgggaaaccccatgtatcataaagtgaatacatagctttatgaaggtatacccagggaactgaaacatctaagtacctggaggaagagaaagaaaaatcgattttcttagtagcggcgagcgaaaaggaaagagcccaaaccagagatttatctctggggttgcggacagaacataacgagaaatcatagttaattgaacacaactggaaagttggaccacagtgggtaatagtcccgtaagtgaaaactatgataatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcagagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcggaaaatgtgagtagtggaggtagagcactgaataggctaggggcatagcgcttaccgaaccttatcaaactccgaatgccacatactatcagtccggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcacgctatttgcgtgagcggtagaggagcgtcgtaatcgggctgaagtcgtaccgtaaggagcggtggactgattacgagtgagaatgttggcattagtagcgagatgtaggcgagaatcctacaggccgaatatctaaggtttcctgagtaaagtttgtcttctcagggttagtcgggacctaaggcgaggccgaaaggcgtagtcgatggacaattggttgatattccaataccactataatcgttattatcgatggtgtgacggagaaggataggatgtgctagctattggatgctagtctaagcgtttagggagttgggattggcaaatccgttccaacaattctgaggcgtgatggggaaggttcacggaaccgaagtatctgattccatgcttccaagaaaagcatctagaaagagaagtagtgcccgtaccgcaaaccgacacaggtagatgaggagagaatcctaaggccgacggaagaattgcagttaaggaactaggcaaattgaccccgtaacttcgggagaaggggtgcctgagaaatcaggccgcagagaataggcacaagcaactgtttaacaaaaacacaggtctctgctaaagcgaaagctgatgtataggggctgacgcctgcccggtgctggaaggttaaggggaacacttagtggtaacgcgaaggtgtgaacttaagccccagtaaacggcggccgtaactataacggtcctaaggtagcgaaattccttgtcaggtaagttctgacccgcacgaatggcgtaatgacttgtgcactgtctcaactgcaaatccggcgaagttgtagtgcgagtgaagatgctcgctacccgcgattggacggaaagaccccgtagagctttactgtagcttagcattgaatttcggtattgtctgtacaggataggtgggagactgggaaactagggcgtcagccttggtggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgaagagtgtaaaggcagaagggagcctgactgcgacacctacaagtggagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtatggtaacatatttagctgactgatactaataggtcgagggcttgaccaatatagtcaagttgtaaatacattaaagaaactgtgtgcaattttgaaagaacaaagttttttcaaattgaagatctcgtgatgatggcatagaggtaacactccttcccattccgaacaggaaagttaaggtctatagcgccgatggtactgcatgggagactgtgtggcagagtaggacgttgcgaggtaagcaaaagatagttgtaatgactatcttttttattttatttttattaaagtcgtaataagttaattatctttatagagaatataattagcttattgtcattaggagaggttatgtattcatataatatgacattgcttatcatatgcccattagtattttgcgcaggtttcgtggatgctgttgcaggtggaggaggaataatatctttgccagcatatatttttgctggaatgccaatacatatggcatatggaaccaataagtttgcaaatggcattggaacatttgcggcttccataaaatttttaagtagtggtaatataaaaattaaaccagcattaatttcagccataggtgctattataggatcttggtttggaacgcaattagtattgctactagatgaaaagtatttgcaatactgtcttattatcatcttacctattgttgcaatttttcttttgtttaatagaaaaattggagtagaaaataacgaaaagaaagtagaacatagaaagatttatttagtggcaggaataataggtttagtaataggagcttatgatggattttttggtccgggaacaggaacatttttagttttagcctttacatcatttttaggattcaatcttataactgcgtctggtaatgctaagatagtgaatttggcatctaattttgcagcactaatagcttatatattaaatggcaaggttttatttatgataggtatacctgcagctatatgtgctagtttaggaaattatttaggggcacattttgcaattaaaagtggagcgaagattataaagccgataataatattagtaataattatgttatttggcaaagtgatagatgctattttatttacaagtagttaattaaatgatataattttaataatgtaataacgaaaacctaaggtagaggtgctattaataaagagtatttattatgagttggcaaacgttgactaataaagaaaggtattatagccgaagatttagattatgcaaaaatttatttctgggtatgcataaaatatatgcataactgtcacgaaagtggagagctacaaggatttggtgaagctatagataataatgttatagttatgatattattatgttttagttttgtacaagttttatgcggttaactctacccgttggtatatatgctaacgggttttcttatttaataaaatagatttgaggagttggaaaagttggcaaaggttgaaggagttctagtaccattattaacaccatttaaagatggaaaggtagattttaaatcttacgaaagaatgattaatcattacgtggaagaaggagtaaatggaattataccacttgcaactacaggagaatcacctacaatactagagaatgaatatgaagaaattttagaaaaaactgttgaatataataagaatagagttccagtatacataggattaggcggcaataatacaagtgaagtaattaaaaagctaaaattagtagaaaagcataaagtgaatggaatactatcagttacaccatattattcgagaccagatcaaagaggtatttatgagcattttaaaagtatatcagaatcaactgatttggatatagtactttataatataccatatagaactggagctaatattgaaaatgaaactgtgcatgtattatctcagttaaaaaacataataggaataaaagactgctgtggaagcatgaagcaaacaactgaactattaatgaatcctccaaaagatttttccatcttaacaggtgaagatatgtatttttatacgacgcttatgcttggaggacaaggcggaataatggcatcagcacatctaaatactaaagattttattgaggtatataacttagctaaggctaatgatcatcaagttgcactaaaaaaatggaattctctatataaaatgataccgctattattttcagaacccaacccaacacctcttaaatatagcctaaagaaactagggctaatagattctgatgaggttagattgccattgatgaacattacaaaaggactagaaagtaagatagataagatattaggtatttaagagaaaaagcataattatgttatagataattgttaaaaaaattgaataagttaactttaataaaaatcactttttattaatttctctataaattattctagtaatgtagtaataacaagggattattttgactactctagcatttaggagtaagatagagactgacaaatttaataaggaagtgattagaaatgatgcctaagttcttttctatgattaagaacaaggaaattactagagagcaagttatgaaggatattatagctggcgttattgtagctgtaatagcattaccgttgtcaatagcacttggaatatcatcgggagtatctccagagaaagggcttacgacagcaatatttgcaggatttattatttcgctcttaggtggaagtaaagttcaaataggtggacctacagcggcatttgtcgttataatttattctattattcaagagtatggtataggtggacttgttgtagcaacgataatggctggaattatattagtaataatggggattttaaagtttggttcattaattaagtacataccacagacaataacaataggatttactgctggtatagcagtaacgctggtatccactgaagtcaaagattttttagcattgaaaattgaaaatgttccagcagagttttttgcaaaatggaaaagttatcttaccaatataggaacgttaaatacatggtcgctaataataggtataagctgtatttttataatgatattttggcctaaagttagtaagacaatacctggatcaatgattgcgctaattgtcgctactatttttgtgaaaatatttaatataccagtagagactataggaagtaggtttcaggagatatcatcaacattaccagtgcctatgtttcctaagataaatatggatgtaataaataaattatttgctccatctattactattgctatactggcagcattagaatcactattatcagcaaccgtggcggatggaatgatatcagataagcatgattcaaatatggaactcatagctcaaggtttagctaatattacatgtggaatatttggtggaatacctgctacaggtgcgattgcaaggactgctgctaatgtaaaatcaaatggaagaagtccaatatcagggatggtacattctataacattgttagctactatgttaattttgatgccacttgcaaggatgataccgatgtccgtactttcagcaattttgataatagttgcttataatatgagtcaatggaaagtgtttaaatcattattaaaggcacctaaaagtgatgttattgtattattacttacatttacatgtacggttatatttgatttggttgtagcaataggaattggaatgatcatgactatgtttttatttatgaagagagtatctgatactactgaaattagagatttggtagaggagaaggttttcgataaggatactaatactgtactagaaaaagcagatggaaggatacgagtatatcaagtaaatggtccgatgttctttggagtagtaaatgagttttttgataaaatgaaggaaattgaatcttcagtgggggttgtaattttagacatgagacatactcacgcaatagatgcatctgcaatagatgcattaactagattacttaaacattgtaatgagttgaatataaaactttgcttaacacatgtacaaaatcaacctatgaaagtactaaataagatggggtttgtagttaaaattggagtaagtcatatatacgaaacaaaaacagaagctatagagaaagcttatgattatgtaaaggaattagaagcatcctagtggattattcccaaggaaatagtaaaatatattgtttagatattgtcgtaaattttaatattttacttaaaagtaatgggactcataaaaaaatttttttaagaatattttcatttaattttgattataagcaataagttgaataaataaagaggtaaggcatggaatatagatgggaaaggacatttccatttttggaagttagtagtgcaacgattaaaaagttatttaaaggtatattgaaagaatgtgacattaataatattataccaatagattctgggtgcaggactacaaattatattgttgaatctaataatctagaaaaaaaatatatattaaaaatattttttataaaggggcaggattataagaaagaaattaaattattaaattttttaagaaactctaagttcgtacctgtaccagaagtatatagagtaagtgaagatgaggatattggaaacagagaatatgccatttatgaatatattgagggaaagactatagggcaggctataagagaaggttatagtttggaggatagttttgttagaaacgttgcaagggctttagctaaaatacatagctataagttttctaaggttggggctttagatgaatgtttacatataagagaagaactaccaccacttgtttcatggtatgaaagcttcatgggagatatagctaagaagcgtttaggaaaaactattgtaaatgacattaatcgcgtagttaggaagaatgaaaaagcattaagagatttagataaggatcctaggcttgttcatggcgattttcaggggactaatataataataaaaaataaaatgctagcaggtatattagattgggagttcgtaatagcagggcaccctttagcagatataggacagttctttagatatgaagaatattttaatagaaaattaattgaggcatttgaatatgagtataataaattttcagattataagcttactcaaaattggtataacataagtaagttaagagatctcgtaaatttgattcaattaataggaacgaatgaggaaatgccaattaagcatgaaagcataaaaaaaataataattaatacattaagtgtttttgattagatgttaaacaaaattaaatctcccttgaaaaaaatgttgacaattttatatggagataatatactatcaataagaacaatggtgtttgagaaatatactcgaaagtatatttctcaagcaccttttttcatttataaaaattataattataattctaagagactattaaattgatttttagataatgtgcgcagttatctctctattaacagttatttgaaaaaatttaagtaatttcaagatgttaattagcaatttatatcttaaacttactatatttaaggggattttttatggaaattaattttggcgatagcagttttatattgatttgttcagcacttgtacttttaatgacaccaggacttgcattcttttatggtggaatggttcgtagaaaaaatgttttaaatacgttaatgtcttcattctttatttgtggattagcatctgtaatgtgggttttaataggctactcactagcatttggggataatattggaggagtaataggaggacttaacttttttggatttaatggagtaggtggagatccttcatcgtatgcacctactataccacatgagctttttgcagcatttcaaatgatgtttgcaataatcactccggctcttataacaggatctttagtaggaagaatgagattctcagcactatttatattcatagcattgtggtcaattttagtatactacccactagcacatatggtgtggggttcaggtggattaataaactctttaggagcagttgattttgctggtggagatgtagttcatataagttcaggagtttcaagacttgtagcttgtattgtattaggtaaaagacgtggatatggtatgatgtcatataagccacacaatattccatttgtagttcttggagccgcattactttggtttggttggtttggattcaatgcaggtagtgcattaaatgctggtccacttgcagttcatgctttcatgacaacaaatactgcggcagcgtcagcattactttcatggatgctaattgagaaaataaaacatggaaagccaacaatactcggagctgcaacaggagctgttgtaggattagttgcaataacaccggcggctggattcgttcccctttggagttcaattataataggcgctatagtatctccaatatgcttcttcttcatgactgcagttaaatctaaattcggatatgatgatgcattagatgcctttggatgtcatggaattggaggagtttggggaggtattgcaacaggtctatttggacaaacagcaataaactctgtagcacaatggaatggtcttttctttggagatattaagcttttaatagctcaaatagaaggtatagcaataacaatagtttttgcagcggttatgacatttattatcttgaaagttatgaaattatttatgactattagagttgaaagtgcagaagaagctgatggtcttgatgtcgctgagcatggtgaaacagcatacccagcgtttactggattagactaaatattaatatatccatgaaactttatagtattgtgtaatgtatatattgtgataaagtatttgtataaaaattagttgtataatttttagatatatattgttaaaataatattatacattatatagatgattagggaggaagtatattatgaaaagagtagaagctattgtaagaccttcgaagcttgaagaagttaaagaagcattaaagaataaaaatataaatggtgttactataagtcaagttatgggatgtggacaacaacgtggctggaaggaatatcataggggtactgaaataacaacaaatgtattaccaaagatagaagttaaaatagttgtagaagatgataaggtagaagatgtaattgaacttattacttcaattgctaggactggtgaagttggagacggaaaaatatttataattgatattgcagatgctataagaattagaacaggtgagagaggaaattcagctttatagaaataaagtattcaccaattaatatagaatctaacttgcagtaagcaataagaataaaatatatagaaaatagtaggttgatctgttttgatatagatttacctactattttctatatataaataatgtattaatattgaaagtgactttttaaaaacttttgagtttaataattttgatattagatatactaatattgttgaattaaaataaagtttattggttcagtagaaaatgtctaataggagtatattatgaatgaaaaagaaatttttttagatattgaggagcgtttaattagcgaagataagccatctatttacttagagaatgcactaaaaaatcataatcttgataattatccattttcaatgataagtgacttacgagatgttgatcagaatcctaaatttcatccggaagggaacgtctttgtacatacaatgatggttattgatcaaggagcagtaaatagagaaagaagcagagataaaagagtatttatgtgggcgcttctattgcatgatataggtaaaaaacctactactaaattaagaaaaggaagactaacatcttataaccacgacagtgtaggagctgaaatggctagagaatttcttacatattttaatatggaagaaaactttatagatgaagtaagagggcttgtaagatggcatatgcaaagtttatttgtaactaaagatatgaaatttcaaaatataggagacatgctaagagatgtagatataaatgagattttcttagtttccctctcagataggttaggtagaggtaatttagatcatatagaaataaataaaacaaaagaggaagtaagaaagtttaaagaaaaaataactgatttcaaaagaaaaaataaataatcatctgaatgtaagtgattaaatttgttaaaaaaaatgtagattaactacatttttttaacaaatttaatcaaatatgtgagattgaacacctgaaggtgaaaattgtgttaatatatgttccaactagattacctatatcctcacgtgattttaatataactatgtctacatttttgagtaccgaaaataatttttgctgatttgataggcttttttgaaaaatttttataaatgcctacaattagtgaaatcactactttaccaccttttaattactatttggatactaatatatagcattaacagcctcattagtgtgtcagagaatattcaatactattaagaatacagttctgttgtatttaatagagtaaaattatacaaagtcaatactgtgtgttaatgctttaatacactttattttggaaataatatattatctaatatttacaagattattttgatactaaattcagaattggatgaagtttagtattcagtaataatgttatttgcatagcctctaaaaccattaattagataagaataaacggcgtttagatttgtattatagagggaacatgctctaacagcctctagaactaattgcgttgataccatatctaaacttttagtattaatgttagtatgttcatttataacatcactcaaattatttaatgatcccatatctactaaaagtaatactcctttaccttcatcgactattttaactttttcaataacagtttgtaatatattagaaggcgtcatttcaagaggtatatctacagctaaaatattatcaacatcaaagagctttctagcaacagcaaccatacttgttgctgcactcgaaccatgagaagcaactactatcccaaccctttcttggtgagaggattcttgtattgaagctaaaagcaatgctagataatcaacctcaattggaggaatagtcatattataacgtttttgggtcaactgatggatttcagttgcaacatcatattctttattgttaacagataactgtagctcaatatttgatgaaaaggaaacctttcttttcttaattctattaaacagagcgctaaaatgtaggcttactgcataaataaatcgttcatttaattttctatttaatctggattctgccagagctttgatctcttcaacaaattcaacaatatctttattgacaatttttaataagacttcacgacgatttgtatcgtttttaagcttagcatagaattgctttaaatgaatattgatgtcagtagttataaaatcttttatataatcatcgctcatgccttcttcatgaagagcagaagttttgtcctcaacaatgttataaatattaaaaggtggtttataatcatcagtttctaagaaagttttatcaccatcgggttgaattgtaattgtgttagggattgtatcacattctgttacattaacttttcctttagcgctaaaagttaaaattttgttttttatattagatgggaataagtttaaatttatatcaatacattcatctgtattaatacagtttaaaaatccttttccacacgctaattgaatattcaatttaagctgtccaacatttccgtaagatgtacttcttattaaagctttaatagattcagctgaaatcttaatagttttgttaactctttgagcttcatttgataataaatagtgtatcaactcaatttgatcatcaattggtctttcatcaaaacttggaatagttatagttattggaatttttcttatgaaagtattaagtaatgtggaattaggatcttccgttgtggaacctattaatagtatactagctcttcgggtgctacctgtttcgccaagtttattgtaagttcctgtatccatgaagtgaaataccatttcttgagcttcatgtggtaatctatgtatttcatcaaggagtaaaatgcctccatcggctcttgaaacaataccatctgtctctttatcggcacctataaaggaacctttgatgtgtccaaaaatatacgatagaagaagttgtggattattagcataatcagcacaattaaaaacaacgaaaggagcatcttttgagagcctttttatatatttagagtattcatacattatgttagcaaataaacttttgccaacgcctgtaccaccaattattaatgtatgcaatccgtttggtgggtacatcagtgctgctttggcttgttcaatttgattttttaaacttgtattagcaccaattagatagttaaaaggtgacttattctcagtaaatgcatttgaaggagaagaaagtaatatattaacatctaatatttcctctaaatcttcaggtagctttatagatagtatattttcaaggcaacttctatcaaaatacataactggcctattttttattttaataattttcttttctctacagagaatattaagctcttttgaaacattattccttaatatatctaatttttcgccaatttcttgggcactaaaccccttttgatctaaaaatttatctttattaaagttcttagaattttttaaaatatagttataaatcttatcaatacgcttcattatagtatcctcctatatataataaatattgtaatatcttatatgagattattcaatagtgtattgatatatattgaaaaaagaaacgctttggattaatagagtattaaaaagtaatgatattatacacttgaaaaaattaagtaatatttagaattgatacactaattaaagtttaaaaatacaactaaaattaagataaatgatttaaacaaattggaagtttataaatattatataagtgttaagaaatatattgggaggaagatatgtttaaaatttttacttttggatttgataatgtttttaatccaaacaatatagaaaagataagtggaattatgaattcatttttagataactttgatataaatgaatttgctaaaaataatgaggatatttcttctgatgaaggaaatagagaagaatataataattttataaaacttaatcggtatgatgatatgtatcatctaactatagatctaaaaggtattgatcttagagagttaagcataagatatgatccaggaatattagatataaacctaaatagattagaaattaaaaaaagtggatttgggatattttctaatactgctcttgttaagaaggcttataataaaaaatttaatgatattgaggatatagacacaaatcagatacttaaaagtattgataatggagttcttagtataataatgcagaaaaagtattcgttagaaaatacatcgaatataatagatgtggattcttatcaagatgatgcggatatacagtaatgtataaggaatagcatgaaatgttttaatgttatttttagagtagttatttttataataaaagcaaaaaagggaggataagctctaggcattatacctaaatttaaatcttcccttaagtaagagtattaagaataaaaagttttattatctcttacgcttattagcaacttcaacattaaccttcttcttattaatttttccaccaggacaattttttaatattttagaagatatagactcatcaacagttacaaatgagaagttttccataaggtctatttgaccaattgctgaagcattaacttttgtcatatctttaatataattaattaatacttttggagtcaaaccgtctcttttgccgacagagaaaaataaacgaacatcttcttttttaggagcttctaatttgtttgaactgtaatcaaatacaatttcattttcaaacttcattttcattagagctgaaataattgatactgcatcataagattcagtcaattctattgcacttggtataaacttagtaagatcaccagctttaatagtactctcaacctctgacatcatgtccttaaattttttattattaatttcttctgcagttggaactggcttttgtgtgattgaacttttagtaacattttgaatttgtttaagcattgaaaaatcctttggagttactaaagaataagctgtaccgcttttatttgctctaccagttctaccaattctgtgaacatatgattctacatcttgaggtaaatcatagttaaatacatgagtcacaccttctacatctatacctctagcagcaacatcagtagctattaatagatttagtgtaccttctttaaatttatttaaagtagttaatctgtgagcttgtgtcatatctccatgcataccttcaaccatataaccttttgattgtagctcttgtacaagctcatcaacgcctcttttagttctacagaatattatagccgaactaggattatctagatcaagtaacctacaaagagcttctaatctatgcttattattaatcataaaataactttgctcaattttagatacagttaatgaactcctcttaatactaacaagtttagcatctggtttcatatactttttagccaactttgctattggatcaggcattgttgctgaaaataataaagtttgtctttcagatggtgtatgactaagaatttcttgaatatcatcgatgaatcccatgttaagcatttcgtcagcttcatctagtactagaaattctatactttctaaatgaaggcattttctttttacaagatctaatattctaccaggtgttccaactacaatatcgacatcaccttttcttagtgctctgatttgtctgtcgattgaatctccaccataaacagctagagttacaattttctcatatttagaaagtctttgtatctcctcattaacttgaacagcaagttctcttgttggtgctaaaataagagatttgattcctctattatcactcatcttggtgataattggtaagctgtaagctgcagtttttccggtaccagtttgtgcctgccctattaaatcagcgccactaagtgttacagggatactttgttcttgtatttgagatggttttgtaaaaccaaggtctgatattgccttaacaatactctctttaagacctaatgtagcaaattgattatcattcattaaatatcctcgtttctttgtttcaaaattagttatttttgtttcgataacttatattaaagttttatatataagtcaaatgaattcattataacacaatagataaattcatgtcaaaagatattataatctaaatatattattagcagcatttagtataaaatatacttaaattgatgcataaaaataagctgcctaatttaaggcaactcgctttttatattagtgtagcttgcaagcactagatatgatagaatgaacagtttcagggagtttttctagctcgtctttgtttagagcagcaacatctattagaggatgtatcactaattctatatcagaactttttattgcattgttattttcttccataagcttatatgtcccatttatggttagtggaactataggacatttagattttgtagccaacttaaagcttccacttttaaactcatctacagacttacctttgcttctagtgccctctgggaatattaccattgaataaccagactttaataaattaacgccttcaactattgattcagcggattttcttaagttatctctatccataaaaatgcaatttatatatttcatccaagtactaataagaggtagtttttcaagctccttttttgcaataaatccttttggaatgtctatgcagcttagaagcaatggaatatcaaagttactttggtgattagatacaaataatacagtttgatcttttggaagattatctaagccgataacattaatttttgcacctgatattttcattataaattttccccaagaatggcttactttatgaatgaaatattttcttccttcaatatcgcctttattggttaagatttttattctaattctataaatagatgaaaatataagacttattattaatccgagataaaaatagatagttcttaacattaaaaattacacacccttaatctattaatttttacactaatcagtatagtataaaaattaatagattgaaagactaaatagattacatacctattaaaaattcaataaaattaatttaaaattaagtaaataattagggtaaaataatattaaaaaatgtataatatataagacaatgataattctatgaaatagtatagcaaataatttacataggcaggagaaatttgatgaatttaaataataatactttgaatatgaaggagaaagatgctgaaactataattggcttaacatctgaagaagttaagcagagaattaaagaaggaaaagtaaatcacattccgaaaacaccatcaagaactatgcctcaaataataagagctaatttgtttacaaggtttaatgcaataaactttgtacttgcagcaataattattctagcaggatcacctaagaatgctatatttgtgggcgttataatagtaaatacattaattggagtggttcaagaaattaaagctaagcgcacattagaaaagttatcagtcataagttctgcgcatgcaaaagttcttagaaatggtgaaataaaggagattgcaatagaagaaattgtattggatgatgtgatttatctggaaaccggcatgcaggtattggctgatggagaagttttgcatagtaacggattagaaatagatgagtctatgttaacaggagaagctgatgcaatatctaagaattacaaagagacattgctatctggaagtttcgtagtatctggagagggatatgcgattgttacaaaagtaggtaaagaaacatattcgtctactcttgctgaggaagctaagcaatttaaaataataaattcagagctacaagcagcaatagataaaatttttagagtaataatatggattgtacctcctctatctgcattattaatagtaactcaactaagaataccagggaatacgtggcaggatgcattaataggagcagtatcaggaattgtaggaatgataccagagggattagtattactaacgagtgccacatttatagtgtcaattataaagttatctaaatatgatactttagttcaagagttgagtgctacagaggtcttagcaagagttgatgtactttgtttagataagacaggaactttgactcaaggagagttaagattgtcagaagtgaagaatattggttctaaaagttctgaagatatagataatgtattagcagcattaataaataatttaccaagtaataatccaactcagaaagctatattagaaaaatataaggaatatgataaggaaatcaaagttttagacaaaattgctttctcatctaaaagaaaatggagtggagctacttttgaaaagcttgggacatgggtacttggcgcaccggaaataatattgggtaagaaatatcagttaatagaagaaatagttaaagaagaagctagaaaaggaaaaagagttttattactagcaaatcttcataataatttgaatgaaaaattagaaggtaagatagaaagtgtagcactattgctaattgaggatatcataagagaagcagcacctgatgtattaaagtactttgatagtcaaggcgtaggggtgaagattatttctggagatagtcctattactgtttcagaggtcgcaagaagagcaggcgtaagtggctgggagaaatatgtggatgcaagagagttgccagaggataatgaaaaattgaagaatttgattcaggagatgactgtttttggaagagttactccgcatcaaaagaaaagaattgttttagctcttcaggagatggggcatactgttgcaatgacaggtgacggagtaaatgatgtacttgctttaaaatcatctgattgcggcattgcaatggcaaatggctctgatgcaacaaaggctgtagcccaattagtattaatgaaatctgatttcactgcgcttcctaaagttcttgaagagggaagaaagcaaattaataatttggagagggtatcagaattatttttatccaaaactgtattttgcataattttatcatttgtatgttctatattatttatagagtatccaatacttccaatacagttgtcattagtgggaagttgcgctataggaattccatcattctttttagcgttattgcctagtacgggtggagttaaaaagggatttttaacaagaatattaactgttagtattcctaacgggatattacttgctatatttatacttataacatttattatatcaatacaaatgaatctcccaatggattacagtagaactttagcagtactaatgttttctggaattagtatggtggtattgcttagagtcgcaagaccgttaactaagtttaaaacgataatgtgtttatctatgtttgggataatagtgttagggttcttaacaccaataggaagatatatatttagcttaactaaaatacaattaagtcattggctcatatcgctagcagtaataatagcatccagtcctctgataaccaaaattgtagatatatttagagttagagttaataagaaatttaaagttaaaacaatttaaaattataaggcttaaatacatatagagggtatttaagctttatttttacagttttggcctagtacattcagattttttgcttattagtttagaagttcatatggagctagaagaagaataagttataatatttgtgttttataaagtatttatgaaaaaatttgtttttttaaaagatattaatcagacctttaatatctaatataatttatttttttatgtaaaaataaattattaatttgacaatgacaaataattgtaataaaatttataagtacaaattaaacaaaaaagaatatttaaatattatgctcctatagttaaatggatagaacaatcccctcctaagggatagatgtgggttcgattcccgctgggagtaccataaaaaaacctgcagttaattgaatgaataagctgcaggtttttagtatatttatgataagataaatattaagtcaatggtgcaatgatggtgcagtagattgcaccaattatagaaaataataagtcacaatgaaaaatggaactgataaaattgcttaaatactaatatttacagaataatgtatactgaatagaaaatgagttaatcgaatccagaaatcgtgagttgtaaaagcatctatatagatataggtgctttattttatgtgaagttttgtatatattgcatatacaagcaatacaattattttttaatattcttgttctattaaagattatatggtaatagtagtacaaatgtcatatgaacagcataaaaaagaatattacactataaatttaagacatatcaaataaattatgattggatatctatataaacgccatataaaagtacttaagtgtaatatgattaataaaaatatatacagatatgggggaataatgatgaattattttaagaattagtttgttataacatatttctatgattctatatattttttacttaagaatttattacttttttggcaccatgaaataaaataagtatctaattgaatattaaaaaaaagagtgctatactttttttgtatagggtactatggtactttatttgaaaatccctgaaatatatataagtgatcctcggctcattaactgtatcagtcattgtatttattggtgtttatgtcaatatattatggtggaattatgctgattcaaatgagaaaaatgacattcgcaaatgaattggaacaattataacaagagcagataatcataataagatttcactttcgttaaatactacttctgaaaaggcattaaatttatcatccttgataatcataaatgagatagtattgtgtggaaggcctgtagaagagaacgtttattgaagcagatcggaggtgcaaaagtgcaaaaaaagatattagttatagatgacgataaagatatagtaaaacttataacaaagagtttaagctatgaaggatttggaactatttcggcatattctgggaaagaagccttatgtgtattgaaagaaaataatattgatttcatcattcttgatataatgatgcctgatatggatggccttgatgtctgcagaagcatcagaaaatcttataatgctccaattctgtttttaagcgcccgggataaggatattgataaaatcgttgggctcgaaataggggcagatgattatatgacaaagccctttagtattcaggagcttaattccaggataagggccaacttcaggaaagtcgacaggctgtttaaagagtggaatgaacttagtccaaatagagaaaagattgattctcctctcattttgaatgataagacttttgaagcatttctaaataacaaaaagcttaacttatcaacaaaggaatttcaaatattgtccatgctcatgcataaccccaataatgtcttgactcgtgagcggatatatgaatatgtctggggagacgaatacggagaattaaatactgtaacggttcatataaaaaatatccgtaagaaacttggtcctgaatatgattttattaaaacaatttggggaattggatataagtacaaggaaagagagtgataatatgaaactgaaaataaagcttcctttactatttctggttatgtttatagtttttatggcttcaattggaatctatttgaagtttatctttgcagaatattcacctatatctagttcattactggatccatcatatatagtattactccttcccatatttgctattgcctgtttcatctttattattttaattatgtatatccatttttgtatagaagaaccaataagactacttaattccagactagaaagaataaatattgtgcatccattgccgccacttgcgctaaggagtaatgatgaaattggagacctttataatcattttaataatatggaaaagaggctccaactagcacataaagagcaaatggatatgattgctgccattgctcatgatctaaaagcaccattaacatctattaatggttttgctgaactgttagccatgcaaaagggtctaccagaaaatgaaaagcaggaatattatgagttgattcaaaaaaagtcaaaatatatggctgaacttatcaacgactttgtaagtttcatcaaagagaaactgaatttagaatccatgaccgtgaaacccgttaatgcatcaaaattatttgagaacattgccctagaatatgaacatgagctatcaggatttgactatgagcttatttacaaacatttatttaaggaaaatatgatgcttatggtcaatgagattatgataggtcgagtctttggtaatctattcagtaatgttgtaagatatggaggaaaaaatgagttaaaagtgtatatgactggatactcacaaggggcttatgcctattttgaaattgaggataatgggattggagtaccggataaggatatatcttcactatttcttaaatttttcactgtggataaatccaggcaaattgaaaatggtgggataggacttggactagcaagctgtaaatcaattattgaatatcatggtggagaaatctatgcatattcttctgaatatggtggcctgggtataaagttcagtcttccacttgtacaacactaattttatttctctaaaataaattaaaggtcactgttggttgaacgtagagaacaccggcagtggcttttttgcttcctaatactttataattttttacattctctttataaagatttattttccttttagggcagctttatttttatatcgtaaaatttacttgtagcttaaaaactacaagtaaattgataggaggaaatgatatggtagagaatcaagttcgtggcacggacatagataggtgccgctatttcgaaacatgtactcttatgcttaatcagagaaggatggaagtaataaatataactagagaaggaggatactgcaatgtcaattgaatttagccgttggccaaacaactatatgatgtcatatcaagtaactaaagctctaggtttggcaagtcttggtgctgctgacgtcaccgaaatttatgaagcatgcaaaaaaatagatccaaatgataaggaaacatggcatagggaatggctcataacagcagaagctttggaaaggcatggtaaggaggcagaagcggttggaaactggtatacagcacgtaactgttacattcgtgcttgcaattaccaccgaatcgctgaatatgctgtgatggataatgatgccgagaaactccgtatatttaggaaagtaaatgaactctttgaagctgctggaaagtactttgatgtaaaaccagagaaaatccaagtagattatgaggatgtcaagttggatgggtactttttctcacctccttggataaaaggtccgaagcccacaattttggccctcaatggtggtgatgagtggtcaattgagaactatttctggttaggacctgcatttatttcgtgtggatataactttatggtctatgatcagcctggaactggtctttcaatgtacgaaaaaggaaagggcagaagagctgacagcgaggcttttcattcaagagcaattgactttcttctaactagaccggaagtggatcctaacaagattattgttcatggtgagagttttgcggcatatgactcccttagatttgctgcattcgacaacaggattgctgccgtcatctctgacggaggaacccacgcgttcgactgggaggcaatgctaaaatggatgccaccaagtttagctgctcacggcatgagaattttgggtgcaaaaagcttggatgactttgctggaaatcctcgttttgcctacaatcttgagggcgtgcttcaccagatagaatgcccacttcttgtgatgcacggtgcggaagagatattggttcagcccaatccgctaacacaagctcttaaaaattacgagcaggctggttcgaaaaacaagacgttcttcgccatagaggatagaagacttggcggattagaacactgccaggtagacaacataaatgtgctgcatgaggtagtactgaattggctttgttctattggtcttggaccttctgcacctagaccaagtgatttctaggatatttttaagttaatcagaaggtggagcttatgaaacttacatttatacaggtggaaccgtgcttgttagaaagcatatagcgagatattttaatttaaggatacggaagatattaaagaaaatttagatgattattttaaagaattaacttatgtagtagtaggatagccatttgccactgtatttaaaatataatgatgatgaaattcctgttaagataattggaattaatggaaagcctggaactggaataaagaaagcaatgatcatttgtttttatttagttcatgttaagttaattataaataaggtatatcatatgccaatttttaaaattcatgataaattagaaaatattgatttaatggagttaagtaatatcgttaaggagacacgtaactttgagggccagtacatatttctaattctgaatgatggaattgagaaacttggaatagaaagaggaagaagttgtattaaggctttcgacagaagaaaaatttcttggagtgtaagttagtatatattagtgaattaaaaaatataatcaaatatatattacaatttggtataaaaggaatacttagagtaataggaactttgagtattcctttttctattttgaagaggtactaacgatgatgaaattatataaaaaggaacaactagaggaactaaaataaaaatactcaaagtaaatattaaattaagtagaggaaataaaaatcatgttaggcgaaaaagaaatagagcttaaaattgtactgtagttgtactattttattttgataagcaaaaaataataagaaattaaacaaaaaaatgaacaaaagttttcatactgattcttaaaaggaaagtcaaaaaaatatagataaatattttaggagtttagtgcatatatacgctaatacttgatattaaatgctagcatcctatatcaaagaatttggatttataaatgtaaaagagatgaggaatcaagagataagagatagtgtttttctctcaaatctaccaacaagctatttcaatatatgtaattatttgtatgaaatagaaattaggcgtataatttaatattatttacaacaagaaaggaggctgtcaataaaaaacgaatgataacagaagatcatttttaattattattaaaagtggacttgcagtgatatcaaaaaaataaaaagttatgtgggaggaataagataatgaaaaaaataaaagtaggttttcgaaataaaaaatctaaaagtttacttattggagcaattgcacttatttcagtaattactgcaggtaattgccaatattctagtgctgcagtagttaataatacatctgcaattcaagatgctagcggaaattctgtttcagaaaaagaaaattattcaatacctgaaaaatctaaaatagtgattggaaaaactgttgaagataagggaattaaggttactctatctgattgttatgcagatactcatatgcttacttttacaacacatttggatagtagagaaagaggtgattatgcacaagagttgaaaccaaatatatctattaatggaaagataatgaataatgaaacaaatgaatttaagtacgattacatccataacgatgatggaacttgtgatatagtgacacatatttacttagacaatatagatacaagtcaaaatttaaatattttaatagattatgataggataggggtaactagtacatccaatattgactcgtatgtaacagggaattggaaattcaattttgcaattggcgcatctcaaatagacaagccgattttagccaaggatattaatcagactctagtaatagatggccatgaactatatgtgcacaatataaaaatattcccatacagaattgaatttacaggaggcagtgatatcgatagttttagtgatactacagatatggcatcatgggaacttacggatgataaaggaaataagattaaggaatcagatggtcatggatctgataaaagtataatgttaaattattttgttgacacaactgatatgagaagtgtaacgataatcccaagaacttcttttaacaaccctgatacagcatatcctagaaaatttcctactattagcaattatgataaagccattacaataaatataagataataagtaaaagaaatacttaaagtaataagaactttaagtatttctttacttatgtaggagaattatcatgagaaaaagattaagtatatgcatattctttattactgtgctaatagtttgctcatcatattatttatatcctagaaaaggaactttaaatgattttttatttagtaattataacaaggaaaatatagaggaaattgagattagaagcacatcgggaggggaagataaaacaattaaagataagattgagataaacgatatgttatttaatttatctaaaataaaactaattcaacattatggtagcatatcaaataggacaaaaatttcttatcatatatatatttacgataaaaatagtatatctgctgaagttattatacaaggcaaggaatatatcagtattgttaataatattaataattctaataaagaatataaaattattgaaaatactttagatttggattatataaatagactaatttcgcagtgaggaatatccagcgttcatataagttaataatatgtttttcatattttgatactaagaatataaataaacttcgagtagtatgtttctatatctataattacatatagattaagaagttatattctaagtagataaaataaaatttttgtaaattaaatgttgtgtatattgtataaacaagcaatacagtacatatttttctaggtaagattaaggatatttggactttgtataaggtaattgatgtataaaaaccatactaatgacataaaaaagaatactgaaataagtattacgtttggataagcaatttataagtagattatattacaaatgccatataaaagtatttgaatagaatataagaacaagaaagtagttatgacaacatatataatagtgtgctaagattgaataataagatagtaatgtattacaataatgttattgcaactattgaaatcgtataataattagaggatgattaaaaatgaaagttgatctaagcaaaattgttaataataaaaaaatcacaccgatagaagaacaagtattagaatatataatcaataatattgatagtgtaatggatcttggcgttagaggggttgctgccgaaaactacacatctacatcaactattatgagactttcaaaaaaattaggttttacaggatttatagatatgatttataatataacaccactaatagatggtggtggcacgggaattatagaagagtcagaagcattaataggtactgatattaagtttttatctaaatatacagatgaggaaaatgtaaaaaggtttatagaaatattagcaagtggaaccaaaaagtatatttttatttatgcaagaggctactctgaaatcactggagaatactttaacaaaaagctgcttggggtagggataaagagcatattaatagattctaaggggagttttgaaaataatctagaagacatggaaacattaatagtaatatcaaagtctggagagactaaagaagtattagataaggttcaagtggcgaagaagaaaaataaagtagtaatttccttcacaaaggaagtagaaaacagtatttcagctctttcggatatttcatttaagatatttgatatgcataaattagatgacagtaatgtgctgcctaactcgttttttgcaaatatgcttatgtttatggaatacttaatctacagatattatcaagaaacaagaaaagaaaataaatagtcaaattaagaaacctgttatcttttaagctaacaggtttcttaatgcttgcaatctatttcaattaaatgaaaacgtatatataatgagcctatggatgacacaataattgataagaggtggaatatatgaaggataaaattatgaatgctatgcaaagattttctaaggctatgtttattccagtattaatacttccgattgtaggtatattaatagcttttggaaatattctcacaaataccaaattagcagaatatgcaccgttcttaaagaatagtgtgatatttggatttggaaaaatattatcaggatccttggttcctatactatcaaaccttggaataatattctgtgttggtttagctgtaggacttgcgaaagagaaaaaagcagaatcaggtttcacatcagtattagtatatttaatatttaataatgccatgaatattttcttgagtttatcagggaagttagtaaatccagataatttaagaggttctggtcaggcgattgtactagggactcaagttttggatatgggagtttttttaggaataattttaggtatagtggtagcgtattttcataataaatattgcaagaaagaatttaatggagcatttcaaatatatgggggttcaagattagtattcttaatattaattccagtagttgttgtattagctgttatactttcttatgtttggccatcagtacagtggggaatatcaagtttaggatattacatacaaaagagtggtaattttggagtatttatgtatggaacactagaaagacttttaataccaacaggattgcatcacttggtatatactccattcttatatagtcagcttggaggaatagagactatagggggaaaggcgatagaaggagcaagaaacatttattttgcacaaattgcagatccttcaattaaagttttatccagtacagttatatgggatgctagaggattatcaaagatgtttggattagtaggagcgtgtttagcactttaccacacagctgatgctgataagaaaaagaaggctagagcgattcttataccagcagcagtaacttcaataatagcaggtgttacagaacctatagaattttcattcttatttacagcaccaatattatttggagtacatgcagttttaagcggtcttggaatggtagctttaaatatattaaacgtaagggctatagcacctaatggatttatagatttcttactttataatttaccattaggtatagaaaaaacaggttggccaatgtttattttagtaggtgtagtgcaattcgcagtttactatgtaatatttagatttctaatagttaagcttaacttaaagactactggaagagaagaaagtaatgaagaagttaaactttatactaagcaagattataaggataaagtaacaggaggccaagggtctggagataaagaatcaacatcaggaaatgaagcacttgtaataatagaggccctaggaggaaaggaaaatattaaaaaagtagataactgtttcacaagactaagattaatccttgatgacacatcaaaagttgatgaagctacattaaagggaacaggagctacaggagtagttaaaaaaggagaaaatgttcaagtaatttatggattacatgtaactagaataagatcgatagtggatgaagcactaggaattgtaggagaataataatataaatcgtagaaatatttgaagaataatataaattaaaggaaagaggtaatatatatgaaaaaacattctattgttattgcaggaggcggaagtacattcactccaggaatagttatgatgctattagataatctacaccgttttccaattagaaaattaaaattatatgataatgatgctgagcgtcaaggtgtcattggtgaagctttagaaattgtattaaaagaaaatgcaccagatatcgaattttcttatacaacagatcctaaagaagcatttacagatgttgatttctgtatggcccatatacgtgttggaaaatatgaaatgcgtgagaaggatgaaaagattcctttaaaatatggagtgattggtcaagaaacttgtggagcaggaggaattgcttatggaatgagaagtataggaggtatgttagagttaatagatttgatggaaaaatattcaccagactgttggatgttgaattactctaacccagcatcaattgttgctgaagcctgccgtagattaaaaccaaattcgaaggtattaaacatttgcgacatgccggttggaacacttcgtcgtatggctggtattgtggacttagaaccaagtgatttggaagttaaatactttggattaaaccactttggatggtggactagcgttaaagataaacaaggtaatgatttaacagacagaattaaagcttatgttgcagaaaatggctacttaacagtaaaagaagtagaaacacaacatacagatccaagctggcaggaaactcataaaaaagcaaaagatttattagcagtagatccaagatttttacctaatacttatttaaaatactatctatatcctgattatgttgtagaacattctaatgcagaatattctagggcaaacgaagtaatggatggaagagaaaaagatgtatttaatgcagcacgtgctatcacaaaggcaggaacagcaaaaggcggagaattccatattgatgctcatgcaacttttatagtagatttagctagagcaattgcctataacacacatgaaagaatgctatgtatagtagagaataaaggtgctatttctaattttgattctacagctatggttgaagttccatgcattgttggaagtgatgggccagaacctttagcacaaggagaaattccacaattccaaaagggattaatggagcaacaagtatcagtagaaaaattagttgttgaggcatggattgaaaatagctatttgaaattatggcaggcacttactttatctaagactgtaccaagtgctagagttgctaaattattattagatgatcttattgaagttaataagggctattggccggaattaaagtaggagtatgtatgtttaagaatttgtttaataaaaataagaataaagtattttatgcttttgctaatggtgtaagtgttgacctaagtgaggttaatgatgaagtgttctcacaaaaaatgatggggaaggagttgcgattaaaccaagtgaaggaaaaatatattcaccttgtgatggaacgatagcggcagttatgaaggaaagtaagcatgctgttggaataaggaccaaagatggagtagaatttctaattcacgtgggaattgatactgtagctctaaacggagaaggttttgaactatattgcgaagaaggaaacgcagtaaaaaaaggtgatcttcttttaagctttgacagaaaatttattaaggaaaagggcttagacgatattactatgctggtaatatcagaacttaataatcataaaattgtggatattcatattgatttggatatgaaggtaaatgagataatcctactagagtacaactagtttgttaaagatacaataaattaaaatgataaattatgaaggttgatttaaatgatctagagtataatatgcgaatatatgctctagattattttttattctctaagattatagttgttaaataatcctttgtataaatcaatatactggcaagagagtcaagtctatatactggagtgacttacaaaagtgataatgtttatataatataaaaaacaaaatacgaaagaagtcgagagattttataatttttatgctatatttttacaaaaaatgtaaaacaagtgtgatattgtatgtaatgtataaatcgtaattacattatatacattacgtagaatgggggatacgatgaaagatgctaccataatgctcagagttacaacagaacagaagctagctataaaaagaatggctagaaagcaaggaatgactattacagaatttatgctatttaatatgatgaaatcgattagtgaatctgaattatctgaaataaatggagatattaatttgaatttagaatccaaaaaatagtaagttgatcttgagttttacctgcttgtatataaagtatagacaagcaatacattgtacaaatactgtttaatggcctaaggtactagcagtatgatagctatataaactacatacaaaggaatattaatggagaaacatttcataaggataaataatttttaggtgaacggtggtataaacgccataaaaagatattcaaatagaatgtaaaagtaaaaaagggggattaaaaaatgagaatcagtgcagacataggctacaatacaacaaattttattggacataacatagaaggctccttttcatcgacagtaaaagaaaagatgcacgagttagagacggctaaatatactgttgagtacaacaataaaacatatttaattggtaatgatgatggatttaccagcatagaacattcaagagataaggatattatatttcatatttgcctatatacagctatagcagctacaatgagttcaacaatagataacaatgtaagggttataacaggacttcctgctcaattttttgcagaacaaaagaattctctgataaaagctcttgaaaatagacgagtctttatgaaacttaatggagaaaatagaagttttacaattaccaaagtaattgtatttcctcagtcggcaggattatttttatatgataaatcattagtagaaaaggatacgctagtagtagatataggtggtggtacactagatatagcatatatgagcaatggccaatttaaagaaggtagaacgtatccattgggagtgaatccgacatatgatgtacttctacaagagttaaccaaatatggagtcaactactctaatcgtatgaaagcagaacaaataattgcagataaagctatatttgtagaaggaaaggaaatagacgtaagcaaggatattgataatgtattaagtttgagagcaggagaaataataaatgccataaaacaggcatttccagagcaatcgaaatattcgagatttgttttcataggtggggagccttattgcttaaaaattatttaaaagactatagagtattagatgatgcacagatgattaatgtaaaaacttatgacataataggtaagagtaagaatgtgtaaaaagttaaaaactacaattactttagctccccatattaaggaatttgcatctaaagaagctaaatctctgggtttagatttttctgcatatataactgtactaataggtgaaaaaatgagaggtactatgataccttcaacgattaaaaaagttagtgatgataaaattgatgaggcagctatatccatagacgaaaaagaatctataaaaatagatagtgagcaggaaaatgagatagatagattgcttcagtggtaaagaacagatgaaaattttcatctgttcttatgtatctcattattaataaaaggatatgaatttatagttgctggattatagaaatttatatgaaatctatgtaatatttcacaaaaagtaaaagaactaatataatttattgctcttagtatgtataatagtaattaagtaatgataaaatgaaattttcattgaaataaattttgattttatgcttactacatgatataaattaatttaaaatatttactatagatataactgtttaaagggggagtgagaatatggaagttgttttagaacagtttattccatcagataagcctaagagaattagtaacatactccaaaagatttcaattgtttttttagtagttggattaatgattgtttttgcatcaccaataatcggaatagcgctaataatagtagcattaatattttttgtgggaagttactttatgtatattgattatgagtatgagttatataatggtgatataacaataactaaggtctacaatgcaagtagaagaaagattgcccaaaagattagtagagatgatgtgagaaaagtatatcttacagaacggaaagatgctcttaagagcggggtggcagcgtattataatactaatataaatggactaaagatttatacttttgaattaaacaacaataaaataatacaattagccttaaatgaagaacttgaaaaaatagtcaagataatttatgttcaaaaaattacattttaaaaatacagtatagttaataagtgtattccttaaactacaaaaaggagtacactttttttatgttctaagaactaattgttttatatataaatttaattcttaaaattagcaataatagtgggaacagtaccacataagatgaattatagttttcgaaaatataaatcatatgaatagggaggcgtaatggataatatattagaaactatgcattgtacatgggggagaaaggaaatttatataatttattatttaggtaaaaaacgtattgacacattatatatggaactggtatcatattaacatgaaaacggttttcgaggttaattgaattaggaggggacattaatgaaggaacaaatagtagcaaaagaaattctagagaatattggtggaaaagaaaatataaaatcagtagaacattgtgcaactagattaagacttatacttaatgataaggaaaaaataaatgaaaaagctattgaaaatattgatggtgtaaaaggacaatttttctcggcagcgcaataccaaataattcttggaacaggatttgtaaataaagtttatgatgtcatagttggacaaaattctgacttagtaactggaaataataaagaggaagcttatagccaaatgacattaattcaaaaaatatctagaacttttggagatgtatttgtacctataataccagtattagttgcaacaggtttgtttatgggactaagaggtcttttgacaaatctaggagttcaaatgaatgagaattttgttctctttactcaagtattaacagatactgcttttgcatttttaccagcattagttgcatggtcaaccatgaaaaagtttggaggtacaccagtaataggtatagtaataggattaatgctcgtatcaccaagtttaccaaatgcttatgctgtggcagcgggaacagcaacgccaattaatctaactatactaggattaaatattcctgtagttggataccaaggatctgtattgccagcattagtattaggaattattgcagctaaaactcaaaaggcacttaagaaagtagttccagatgtattggatctaatagtaactccatttattacattattattttcaatggtactaggattattaatagttgggccaattatgcataatgctgagcaattaatatttggagcaatcaaaggattcatggggcttccatttggattaggtggactagttgtaggaggagtacatcaacttatagttgttactggagttcaccatgcattaaatgctttagaagttgaattactatccagcacaggaaaagatgcatttaatgcaatgataacttgtggtattgtagcacaaggtgcggcagctttagcagtagccgtcaaaacaaaagataaaaagaagcgctcattatatatttcatcggcaattccagcatttttaggtattactgaaccagcaatatttggtgttaacttgagattcataaagccatttatatttggatgtgcaggaggagcagttggagggatgctttcaggaatacttcacctagcaggtacaggaatgggaattacagcattaccaggtatgctattatatgtgaacaatcttggaagttacattttagttaacgttgtggctatagcggttgctttttgtttaacattgttcttcttcaagccagaagaataggaataataataaatatttagatgaattacagatagatttagtagggataattttgcttgctaaatctatcaagctatataaagttatattttatatattaatatccatataagtttataagttatcttttcaataatatgtattaatgatatataataatatttatataaaacatatatggaggataatatggatcgaaaagtcacaattcaagatattgctaatatggttaatgtttcaaagagtagtgtttctagatatttgaataatggatatgtgagcgaagaaaatgctaagaagataaaagaagcgattgaaaagaccggatttgaaactaatttttttgcaaagagattaaagactaaaaaaagtggattagttggaattgtaattcctagaatcgattctgttacaataggcaaagtattaactggtatcaataaaaaattaatggaaaatgattatcaaggaattattttgatcagtgaattagatatagagaaagaactagcaaacattaatagcctttatcagcaaggggttgatggaataatcattaattctatggctattactaaaaagcatattcaattaattagtaggcttagtattccaactatatttacaggacaaaaaaatgagtttactaattatataaagatagatgattatgaagcaggaaaaatacttggaagttattttaaatctaaggggcataaaaatatagtgtttttaggagtaaatgaatgggatatagcagtaggagtggatcgtaaaaatggattcattgatgctgtgaagaaagataatccagattgtaatgttcaatttgttgaaactgatttttcatttactaatgcatacagtaaggctagccagatattagaatataagcccacagcaatagtttgtgcaactgataatatttgtttaggagtacttagatatttacatgaaaataatattaaagttccagaagaaatttcagtagctggatttggaggatatgatataggaagtgtttcataccctacacttacaacagtagcttttgattatgaattaattggtataaaagcagctcaaggaatcctagatttaatagagggaaaagagttagaagagaataaggatacttccttgaagctaatagaaagagaaagtgtgggtgggattaattaaattaataggagaagaggaaagatgccaaacccaaaatcataccaggaaataaaccaaaatttaaataattattacagtaataaagaaatgagtatatggcgaaacaactttcacattgagatgccatttggtttgatcaatgacccaaatggattaagttattatgacaataagtttcatatattctatcaatggaatccatttggatgtgagcataaaacaaagcactggggattagtaacaacaaccaatttcattaactttactaagccccaaatggcgttaaaacctcaagattggttcgatagaaatggatgctattcaggttgtggattggttaaagataatgagttgaagttatactacacaggaaacgtaaaaggtccaaatggagaaagagagtcatatcagtgcttagccatttatcgtaaagatggaataatagagaaacatggagtaattatagataaacagccaaatggatatacagctcactttagagatccatatgtatttatagaagatgacacttattacatgatattaggtgttcaaagtgaagacttaaaaggaagagctttaatttatgaatcaatagattcagttaaatggaacttgcttggtgagttaaaaaccgatatgaaggactttggatacatgtgggaatgtcccaatataataaggataagtaaaggcaaacatgcatttatattttcaccacaaggtttagaaaaagaagaattgaaaaatcaaaatttatatcagtcagggtatgtaattggtgagctagatatagagagcgttgagttgaaaaatcatagtagatttaaagaattagacatgggatttgatttttatgctccacaaatatttaagcataatggtgaaaatataatgattggatggatcggaatgccagatagggactctgaatacccgacatatgagcatggatggatgtattcattaactatgcctagagttttagagtataagaataatgtcctttatcaaaagcccattaatgaaatgagaaatttaagagaaaatgaattaataaatattaaagggctaattttgaataactacaatttagctttagagtctcgttcagtagaaataatgataagtatagaagttgaggatattgaatctacagaagttaaatttaaatttaatgacgaatatattctgataacatatgataataaaagacaactatgtacagttgatagaagtaatatgaatattggcggaaaaggcataagaaaattcaaattaaattcttcaaaagaactaaaaatgaatgtattcattgacaattctgtgatggaaatatattatcaagatggattagaagtaacaacattaacatattaccctaagagtgaaggattagaacttcaaataagaaatgatagcaaaattacaattaatgagctaaatatgtggaacttaaggagtgtgaagtatgaataataatgttttttgcattggggaacttttaattgatatggtttgtgtagataataaaggtttaaaaaatggagagaaatttgagaaaaaagcaggtggagcaccagcaaatgtagcggcgagtatttgtaaattagaaggtaatgcttattttttaggacaagtaggtaatgatttttttggtaagcatttagttgagctgctaaaaagcttgaatataaatactgatatgactgtagaaagaggaagtacaacaattgcattagttggaattgatgcaaatggtgaacgtaactttgacttcctaagaggtagtgatggggaatattcgtttgataatatagatttatcaaagataagtaattcagatataattcattttgggtctgcaacgggatttttagatggagagttaaaaaagacatattttaaactattagaatatgcgaaatctaataacatatatgtatcatttgatcctaattaccgcgatgcactaatcactcaagacaagttagagttgtttgttgaggattgtgttaaattcttgagatatagtaactttacgaaactaagtgatgaagaattatatttaataacaaaagaaaaagatatagaaagcgctgttaacaagttacatgaaattggagttaaggttgtaacagttactttagggtctaagggcacatacttaagtgttaatggaaaaaatgaaataataccatctatagaaattaagcaagtagattccactggtgcaggagatgcctttgttggagcagtattaagacaggtatctgatattgatgacaaagagagtataagttttgatagatggaaagagatagtttcatttgcaaataaggtaggtgcaataacatgcaccaactacggggctatagcctcaatgccgacactaaacgaattaaattaagccgagttagatgaattcatatataggagggagatattttaaatatatcccttctatatttttggatttttatttgattattgaatataagttaataataatgagtatgaaacttatgattttatatttttattatatggtagaatattgagaaaggaacatatataatattaaaaatatttagtcaagaaaattcatgatgggagcattacaaatggttgattttctaaaaattgcaaaagaagaagctaagatggcaatgaaaaaaggggagattccagtaggagcagtaattgtattagatgataaaataataggaagagctcataatttaaaagaaaccttaaatgatagtactgctcatgctgagattttagctattaaagaagcttcgaaatttattggagattggagattaaatagagctgaaatgtatgttacattagaaccttgtcccatgtgtgcgggggcgataattcagagtagaatatctaaagtatatataggaacatttaataaagatatgggtgcttgtggttcagtaattgatgttacagataataaatggttaaattcttttgtaagtactaaatggctatatgataaagaatgttctgatatcatgttggagtttttttgccagagaagaaataagtataaataaattataaaaaatatatatagttaaaagtagaattaatttttaattttattacaatatggaaataaattatgcgctttaaatcttaaaagtattagatttaaagcgcttttcttatttaaagagattagtaaagatataggtagttagtgagagccaattggaaatatggggaataaaatcacatttttagaatattatgaagttgagatataaaaataaatatgatatagtaatagcaactggtcagaccactataccaatgatttttacacaagaggtgatttttagttgaagtatttaaagcagttaatgattattctagtatcatattttttaggaacaatagtacaagtagtttttaaattacctataccagggacagttttaggtctcatttttcttttcttagctttatattttggaattgttaaagttgagatgattgaagatatatgcgaggtattaatatctcatatgtcattcttatttattccagcaggggtagggttagtgacatcctttcaagcaattaaaggtaagattatacctttttccactataattgttatttccacatttgtagtttggattgtgactgcctacgttgttaaatttctaaggagggtgacttcaaaatgaatgatatgataaattcacctgttttcggggttttaatatctattattgcttatgaaataggtcttttaataaaacaaaaacttaagctttcaatatttaatccattacttatagcgataataattctgatcacatttttattaaaatttaatattaattatgatgattacaatagcggggggcaaataatttctttctttttagctccagcaactattgcattagcattaccattatataaaaagttttctttgtttaaagaaaatgctttacctattttatcaggtattttatttggagctgtatctggaatgatatctgtaattctgctttcgaaggcatttaatctttcaagcgagcttacaaaatcattaattcctaaatctataacaactcctataggaatggcattatctaaacagttaggagggcttccttctgtagctgttgttgctattataattactggaatactgggttctatcattggaccattcctatataaaatattaaggataaatgataaagtagccatgggaattgccatgggaagttcatcacatgctgttgggacagcaaaagctatggaaataggtgaaattgaaggagctatgagtagtttaactattgcaatttctgggattgtgactgtactgatagcacctgtattatggagtttattttcagtatttttaaattagttagggggaattatctttgaatggagataaaaataactacaaaaagggagagagtccaattaataagttatttagttctattgataatttattaattgaagagagagaacagaggctaaaagtaaagttaggaaaagagataaaaaatagcatattcacagatgaaattataatgaagcttaatgagaatgacttctctggtctaattgatgaggaagataataatatggcgatgcttttttcaagtatatttccagtatttataaaaagtagagatgttgtttttagactgtataagcataaaatagaagttaatttatctgatgaaatgagcgatagatatatttatatcttttctgatgggaggttgacctctggattatttcaatgttttaaactaagtgatgatgaatatgtatatggaataaagagaataattgatagtattcctctttttaaaattgctattatgaacacattggatagctttagaaaaaatattagtatacataatcataaaatagagaattcaaaaaataaagaactgttagcagaaaaaaattacaacgaattacttaactacttatcaaaagcaaacatataaagttttgagaggatgatatcgatgttaagtcctgtgaagagtacaaaaatatatgaaatagtaatagagcaaataaaagaaattgttaaaagaggagaactaaagagtggagataaactaccatctgagagagatttatgtgagaagcttgaggttagcagggcatctgttagagaagcactaaaatctttacaaatgcttggacttatagaatctaagcacggggaagggaattttatcaatgaaaattttgaaaatagtctgcttgaacctttatctattgtattcttacttctaggaagcaaaagtgaggatgttcttgagcttagaaaaataattgaaccagaaacagcagctatcgctgctaaaaatataactgatgaacaacttatagaattgaaggaaataatggacgaattaaataataattcagatattgaagcctgtgctatattagacaaaaaatttcattataaaatagcacaagctactggcaatcacttaatttcaactataatgttttctatatcttctttggttgaaaaatatattgaaaattcaaaagttcatactattaataaaatacttgttaaagaccatcatgaagaaatatggaaggctttaaaagaccacaattctagtgcagcctcaatcgcagcacaaaaacacttggaattaaatcatattgtttagaatctatttataaatttaatttgcatatttctgtttaaagttctatatttaataattaattttaaatagggagatgattatcatgattattgataaaatattttacaaaacattatttaagaatttattttcagatacttttgaattaaaactttgggatggaagttcagaaatttatggggaagggaatccagaatttaaaataatatttaatgagcctattcctaaagccgatattataaaggatccttcattaacatttggtgaagcttatatgactaaaaaaatagatattgaaggaagcattcaaaaggttatagaatctttatataataatcaggaaagttttttgagtaatagtgacaaatatgcaaatttactaaggatggctacaaatagtatcaaaaatagcaagaaaaatattgagttccactacgatattggaaatgatttttataaattatggttagatgatactatgacatattcatgtggatacttcaaatcaaaaagtgattcattaactcaagcacaaaagaataaagtagagcatattcttaaaaagttaaacttaaaagaaggagaaacactacttgatataggttgtggttggggtgaactgataatatctgcggcaaaaaaatataaggtaaaagctatgggcataactttaagttctgaacaattagcaaaagttaaagaaagaataaaaagtgaaggattagaggatcttattgaagttgaacttgtagattacagagaactaaaaaatagaacatttgataaaatcgttagtgtgggaatgttagaacatgtagggcaagatcatcttgcagagtatttttcaaatgtcaataacttattaaatgataagggtgtatctttacttcactgcataacatcaacagaggttggaggaaataatacatggattgataaatatatattcccaggcggatatgtgccagcagttagagagctaatcaattgtatgtcggatgaaaggttcactttaatcgatgcagaaaacttaagacttcattatggaagaactttggagcattgggcaaagaattttgagaatgcattgccagagataaggaagactaaggatgaaacatttataagaatgtggagattgtatttaaatgcttgtgcagcatcttttaactccggaaatataagtattcatcaatttgtattcaataaaggagtaaacaacgatttaccatggactagagagtatatgtataaataagtccatataagtactttaagagataaatttgtggtattactaaattatagctaattaaataagaagtaatttatagtaggcaaaagtacttaaattttaagtatttctgcctattatttgcattaattacgaaaatggaaggatgatggtttatattgaatatgaataaatagattctattgtattaaatgatagaagttctatatataaaatattcagttgaatcgataacaattatatgatattataataaagcattaaatacaatatggagagatgtccgagtggtcgaaggagcacgcctggaaagcgtgtataggggcaactctatcaggggttcaaatccccttctctccgccaccgcatatttaggggcttccaggtgtgttccaccttatggaagcataaaattactatacacgattatttacggaaaatatccgaatcgtgtgtagttttttttatgtaaaggtggtagatattttgaaaagaaaaataatagaagttagcactaaaggtataacctttgatagaggctatgacgagtttatcttcagctgcagagctaggaatttaaggcctgcaacaatacaattctatgataattcaatgaggagtatttataagtttattgatcctaagatgccaataagggatataaccaaggctacagttgataactttattataggttgtcagactgaattggatataaaggacataactatacatacttatcttagagccctaaaggccattctatattatttcatgagatcaggatacatggaaaagtttcatatacctttaataaaatatgataagccagtaattgaaacatattcggatgaagaagttaagttacttcttaaaaaaccaaataaaaataaatgtaattttattgaatttaggaattgggtaatatgcaatgtgctttatgctacaggcatacgttcctctaatttaattaatctgcaaatcaaagatatagatttatgtaataatttaataagtatgaaaacaactaaaaacaggaaacctttagtaattccaataactaaatcattacagccaattttgagggaatatttagccattagaaaagggaatgaagaagattatttattctgctcagcctatggagataaaattagcaaagtagctcttaatggaagcatgagaacttataataatggtaggcgtgttaagagaactggtatacaccgatggaggcatacttttgctaagcaatggatattaaatcatggtgatataataagacttcaaaaaatacttaatcatagtgatttagacatggtaagaaattacgtaaatatgtttactaaggatctgcaacaagactttgaagaattcaatcctttagaatttgttaataagaaatcaattaaaatgagaaagtaaaggagagaattataatggcaagaattaagctaagagccttcagagaggtcaagaattacactagaactgtatcggattgttacatggaatatatgaattattgtaagtatagagggcagagagaaggaactatcaaaagcaaggaaggcttttataaatatgtattaccaaaaatgataagtgttgatgaagatataactaaaataactgaaagtatggttctaattcatgttaatagtatgatagatagaggacttaaaggtggtacttattcaacatttgtagttaaattaaaggcttttttaacttattgttttaaaagaaaatatctacaagaatttgaagttaaaataccaaacgtagtgctagagaaaaaagcagtatatactgaagatgaaataaatattttactaacaaaacctaatctaaatacttgtgttataggtgattacagatcatatgtaatgattgcattttttgtaggaactggatgcagaagtgaaactatacttaatgtaagagtgaaagatattaattttgagaaggattcaatattatttagccatatgaaaactaaaagacaggcaactgttccaatgtcaaagtttttaagaggtgaactactggaatatataaataatatgaaccttaaacacaatgatttgctatttcctaaaatagatgggactcaaatgtcatatgatacaatgcatcaaaattttaaaaattactttaaacactgtaatattaaaatgcatggtgttaatacctttaggaatacatttgcaaccatgtttattaagaatggtggagatatctacaggcttaagctgctattaaaccatagtacaataaagactacggaaagatatattaacctgcttccattggattttaaagaagatttactcaaatataatccattagataatttacaaaataacattattaaaggcacaaagttaaaatttaaaaatagaaaataagaaaagggaagatatttaattgtcttccctcaatgtacttatttagagttattagtagtttcgttcgacttttttgcatttctttttctcataatctcatataaatataaatcggcttctgacaaatttatcaatccctttcaattattattttttctttttcttatttagtagagctaagatttgtagtaaatagatttcagcttcattcatgaatttaagcctcctatacgtttttgataatctacgcttttaaaatggcttttagctcatctaaaagtctacatagttctaaaatgatttcatattcgctcataatattatcacctctaaatttattttatatagtttttaataccacttcttaagatttttagtatctttctttgtatatgtgactaaatcactaacttttttaataccactatatttcttctttctagcgatataataatcttgaactaaattcataacatcaatgaatattttatatttaatgtcctcatattcttttaagctgatttgaaaaaaatacttagcattgttattagtgtgtatctcataccagtaatactttacaatctcacgatatactggtggtttgttgttgaaatattttcttacaagtttcactatttcggtattaccttttcctgatattaatattggtcttatatcacttaaattttttatattaatcattgcagctcctttatatcaaatctttttcgctatattcgtaatctaaatcattgtcataaattttataaacatctgctacgctccaatacattccaggtgtttgagtgtcctttatctcttgttttacaactaattcccaagagcttttatattttgttaaatagaaattaatatcattctttaggttcttaccatctgcaaaatagctaaaattgatattccctaggtttaactcttggcacttgctttttaattgaactatgatattttctgtttcttgatctatgtcataatattttttcatagtgtacctccatagatttatttttgaagaaatattctcctttacatagagcacatctcgtgatacactttaattgcgagttaagggtgtatctttagatatgctctttttatttttaaattaatacttcttgttgaatttctttaggttcaatctcatcttcaaatggaacaatatcatcagtatctttaaatgttattccacatatttgatatgttttttgatccgaactcccatcggatattcgcttgcctttatatatactggaaaagccttctttttctttgagaagattaattatataattacagcgtttggtttgattttttttattaccagtgtcttgaaaactgtagggtataacactttctaggccttcttcttcgcaaaagttaagatattcttcttcgaattcagaatactttatataactgccttcaaaaggtgttataatcctcttagaaaaactcaatagggagtctacttctgataatttagttgatgtatcattttttacacaatcaggaatatttaattttttaccgatcatgtctattgccttgtaaacaaaatatgaaaaaacataatcaaaattaggaaatatttcgtctttataataatcagcattccttttttcaatcggaataggtttatcaaatttaacaaaaatcaatcttcttgatatagccgaatccatagtactaaatgaaggcatagcattagtatcaaaaacaatatcaaggttttgtaagcttacattggttaatccttcattggtttttctagcagattcatccgcatgtgataatatctttttaaatttagcagatgatattatcttttcttcttctccttcactacaaaatgcaatttttttattatctaatgaagcaagaatatcatctctggatgcgtctgagttacctctattcatagttgtcatataatcatatggtatagttgaactttcagttttaaatagatctctgataatattctttaggctacttttacctgttgcacctgctccaatcataaatattgctgattgtaaacttctatttagcattttataagctattaaatcaagaataaaatcaagcctttcattgcctattatgtctaaataaatactcatcttctcagacataaattttattgattcctctttattaacaaggttatattctgatgtgaaaagtatcatatcattcctagttgcattctttatttcaccagtatttaaatttataattttgccatcattagagcagataatattattatttaaatcatatttctttaaatcaattatacgagagctctcacgctttattttatctaaggcctctttcgtgtttctgcctgtatcccatttagttattttcttagctaattcaagccaatcttcatatttaagagaaccttgacctgcagatagttctatattacatttttgaatgaaatctccataaattatttgtgtctcttcatctgttaataaagaccaggtactaccattccaataagcaaatcttttcttgtcagtgctgttaattaaggctcttaagtttccattaacaaatgataaaaaagcttgtttattatcagcaaattctataagtgatatgtccttcagtttatctatattgccagttattttatctataaaggcgttatagtaaacttcactttcttttgtttgtgaatattcctttaagttgttccattgttctagtttggaaagagttttaacaatttcaaaatttaaaaacatattttcagcattctgaaaggtttttatagcgtctgaaaaaatgtcaagatttttatgcggaaattccacattaatatctaataataaacttttatatttttctcttgcttcaagttctgcaaacatataggataatgcagaaaagcatatgtcaatttcttctatagtaaatttaattaatttcaaaggcattcacctctatttaaatgccattttataatgataaaggcctttaaaagtcacttccttacctaactcatggcattgctccacatattttttcaataatttaaattgcattactttacaccttctttatctgattaatattgctttattactttatacccaacttcattagttaagtcataatagttatgttcatcaattattttaattttaatatccttttgagttacaggatctttcataatttgaattgattttgctgtagttttatccatactgaataccttccttacttaatatttacataaactttgttgtattttccattattactggatttaactggaccagtaggtcttataaatgataatatttcattaatttttgatttatctgtttcattttcataactcatagtaatttttaacattaatttgtacctccataatttatttttgtgttagccatggagcaggagctaacttgtattattagatatgattttttagaattttaagataggatttctaattaattttcattagacaaaaaaagttgttcaacacttgagccaagagcagtagctattttttttaatgtacctagttgaatattatcaactctgccattttcaatttgtgaaatagtagttctgcaaactttagcatctgttgccaaatcatcttgagttttgttgttttttactctttcaacttttaattttgaatatgtcatgttatcatctccttaaactttgcgaaacgcaaatcttaattatataataatattcattacgcaaattgtcaatgagttttgtttaaaaatatttgcattttgaaaattaaatgatatgatatgtctaggaggtgctttaattgagttttggaaataatattaaaaagtgtcgtttagataaagggataaatcaaaaggaatttgctaaaattctcggaattccagtttctactttagcaaattatgaaaataatcatagagaacctaaaacagaaatattaattaaaattgctgatgcattacttattcccatagatgaattgttagattctgaaacaacatcattttcaagtaatttaataacatcaatgctccagatggagcatattactattgttgatgcatctgaagaatatggatttaaagcaatttcgcgtgatagtggtgttaatataaattatttaagaaattgtatagaagaaaatatagagctagcgatagaagatcaattaaaacttattgaattttggagtaaatataaatcatgggatgatggaattgaatttgaagattttattcgtaagaatgaaaagaaaattaacaaaaatcctattatatctaagaaaataaaagatatactcaacattggaatgcaaaaaaatgacacagaaaaattatttgatttattagaaaaatatgatttcaaaataaatatatccaataaagatgatgaaaatataataagtatatataataatgaaaatcctataataactgaatctgaatctaagttattgcctatatacaatgaaattataaataaaatcgacagttacgcaaaatttataattgaagatgaattaaagaaattaaaaaaagattaattataaaatttaataaatattttaatgatcctttgccaaacaagtaagggattttttctctataaaaatgagtagacagttttagagaatatgtagatttattgaggctttacttaaagccagttatatcaatagttaaagcggtatttagacaagtagacaataaaaagtgtctaccttttttatatgcaagtgtctaccgagttaggccagtaatatcaaagggtacgagattttttatagcttagtagacagtagacagttaaaatcaaattacatatcatatattattattttttatatatttatatattatatactgtctaaattgtctaaagagatataatataagtaatatagcgggtttagaggtagacaaaagtgtagacagtagggttttaaaattgtctacactgtctactaataatataaaatatttattaaaaaataccccttaaaccattgaaaacactatgcttaaagctaattatatggtataataaatatagagatagaaataaaaataacttaatacaatttaatattttagtaccccatcaaaagatggaaagcattaagaatttaatggctgcgggaaataaattttactaaacgtaattatgcgttaagtgatttattaccgtggcctttttattttatcaaaatataaggaaggaggattgtaaaatggatgaattagaaaaaaaaactgctcaagaagcatcagatcaagagcagtctaagtttgtaccaatagatagttctggaacgatatatccaaaaaacgatccaggtattaaggctccaattaattaaagatattatccttaataaatttccattgttcttcagacaaccagccttgataattcgtttttttagtttcaactattataagacgatcgtttgtatctaagaaagattttattttatcacatatttggttggctgtgagattagattttattaaatatgaagatttccaataagagcaccaagcaatagaagaatcttttatagcttttattacatcatcataatcttgtccagatttattaaggtcataagtaatcatatatgcactcataaaaatacacctcctttcaagataatcttatctaggcgtttgcgaaacgccgcaacccgcagaaatgcgggatatttttttagcaaaataaaataactcctcactgatttatggtaaaattgaattgcctaaaaacaaaactaccatatacctcagaaaggagtcatatatatgataacatataaacagctttctttggcagatgtttattctgattgcaaagaaaaatttgaaaatgataaattccaatttctttctttactcgaaaacactatcgaccttgatgagttagttcctgcatctttcattaaccatttttacgcttccacaggaaggccgcgaaaatatcagctttatgctatgatcagtgctttaattttacaacgcattttttctattcctacagattctcttttaattattttccttaaatattctcaagaactaagagacttctgcggctttttaagagttcctgattcatctaagtttactcgtttcaagcaggactttcttttggacttacaatccatgttcgataatcttgttgatattactgaaccgatatgccaacagattgatacggctcttgcttccatgactatttttgatacttcaggccttgaagcatttgtcactgaaaataatcctaaatatgctaatcgcattataaaacagcttaaaaattttaagaaagcatgcaatttagatgactcttatgatccttataaagctgcctatggctctatgccatcacacgcttcagccaaccctgccatccaacaaatgtatattaatgggcatttttgctatgcttttaaattcggaatcattactaatggcctcggtatcgtaagagatatttcgttctataataaagattttctcaatgctcatcctgatattattgttgagaaaaaatctgattcacctgatgaagataaatctcttgcagattctaaggctcttatccctgttctcaaagatttttttaacaagcatccattaataagtccaaaaacctttttaggagatgctgcttttgacagtattcaaatttatcgtgatcttcttctcgaattaaaatttgataaagcatatattcctttaaaaactaggcttacactagaaaatgctgattgccctttaaacgaagacggcattccatgctgtccgaatgatccttctattccaatgaaacgtgaaggtagtaaaagtcatcttcgttctagaattccaacaatgaagtttgtatgccctaaaatgaaatggttatataacaaagaaaccaaaaagagcaaacgtgtaactcaatgtgaaaatccatgtacaaattccttatgtggacgaatgttttatatttatcctgaaaagaatctgcgcgcatatcctggaataacacgaggaacccaagaatggagtaatacttataaaatcagagtagctgttgaaaaaaatataaatcacttcaaatatagttactgcgtcgcggagcgtaagactcaaaatgagcaaacacttcatgctgatttacttctagccggaataactcaactaataacagttatcgtggcagataaaattcataaacataaatatatccgaagcttaaagccattaattgcataaaatttatttataaaaattggaattcaccttcgctttatttcgtgcgcccttttttaagaagtcaactattatatttgtatagcaggaaccattaaatccattaataatgtttttgcaacttcaaatcaatcattattcatttttatcaatgagtttcgcaattatctataatcttatcacattggaaggaaaaaaggaaaattaaggaggaatttatattgaatgatagagccaaagagcaaaaaaacgcttatatgaaagaatggagggcgaagaataaagacaaagtcaaagcagctcaagagcgttactgggaaaagaaacttgagaatatgaaattgaaggaggagaaataaatgaaagtaactacaaataattttagcttagaacaaagaaaaaaggtcaaagatgctgaagcaaaaagagatgaatacaatgcattagaaaagaaaattgtttctctaaaaatagaagatttaaaaaatagaaataaagcacattcactagaaataactaatcttagtttgcaattatcgaaactaaaacaagaattaaatgaaaagacttatgaagctgctaaagcaataggaatatattaattaggataggagataagagaaatggaatataataaagcacttgagaattataaaaaaattataggtaatatagaatcacaaattaaggaaagagaggacaaggtagctgaacttaaaggaaatattcaaagcattaaagaggatagaaaaagggaagtaaagaatggaatatttaccaagacaattaagaagtttactaaaactagtacaatatcagagattggggcagatattgaagttctgttatatgaaatagaggcattacaggaattaaagaatggcgattcagatgagttgatgaacgcagctaaggacctggttaattccgtatatgttgaagaaaaaagaattcaggatgaaagaaaagctaaggaagagaagagacaagaacttttaaatcaggctaaagatatacaggatgatctttataatactgctaatgatatttcaatattaagaactagtacagctaatgtgttatctgaattaattaaaactaaatacgattcacagtatgcagcatatattaataaaggtttggaaacatttcatttagcagaaaaattattggaagaataagttttgtatactcccccccctaaaaatagtcacagaaatataaatggagaccgatgagtagacctccaaaaaatgcacatgagtttctgtgtagggggtgtagtctaaaatgaataaatatttgcaattaaaaagaagtatttaagcaaatttgcttttattaagaagaatatgaacataagtaaggggattcgtgctcccccctaccttcaaatgcaacaagtaaagaataggagaccggtgagtggaacttcttccaatagagcgataaaattgattttttaaagggggtgtgatacctcctaatacgctctatgtgaagagaatatcaagtgtgacataattaattatgataagaaataagcttgtttaaggcttgatatgataggtttgttggcattaatttagaccaaatttgaaataatgtaaaaggagaaatattaatggttagattatttaatagtagggaaacagatttttctcataatgaatatgtattaaatgagattatatcttgcaaagttacggaagagttaaatggagattatacactggaacttgaatatccattagatgatagtaaaggtatttcaaataatttagttttaggagcaattatatcagttccaactattgattcaagagaaaatcagttatttagggtaataaaaaaagagacaaactctaattctattactgtacaggctcaggctaaattaatggctgatttaaaggttaatgcagttagagcagcaaccattacaggaaaaactagaaaagaagctatacaaactattttaaatagtgctttggattcgcatgtttatacagctggtagtttagacacaaacaccaatacagatgttatattgcaggtcagcgaaggaaacttgcttagcgatcttattggtagtgagaatagtgttttatctgaatatggtggcgaatttatagttagcaataatgctcttgatatagttaacaaaagagggcaggacaatggagttgtcattgagcatggtaagaacataagcagcataaaggaagatatagatattactgattttgcaacagctttgattccaaagtcaggagattatagacttccagaatatttaattgtgagtccaaatgctggagcatacgacaagctatactgcaaggaagtagatttaaatttaaatatttgggatggaacaaatgataaaggtgacgatcaggtaactatagaagaagcttatgcacttatgagacaagcctgtagtaagatgtttacagttgataaggtagaccaaataacctttaattatgaggttgattttgtacaattaagccaaactgaagaatataagaattatgcaatacttgaaactgttaacataggcgacacagttacagtaaggcataaagtgcttaatttagacctacagggcagagttaataagattgcctataaagttgatagtgaaggtaatacaactattgatacggttgaaataggttttactaagaaggatattacagacattataagtgataccgtaaagcagattaaatttactaagcaagaaatagttctacaagtttcaaattctgagaaaaaaataaatgcaagaatagacctacaggaagaaaagattgatgcagtagttgaacaggatggtactggatttggttgggaactttctaaaagtgcctttaaggtggcatgtgttggtgctagtaatgcttatgtaataatagatgcaaatggtctagaggtacatgatggtaagtttagattatataaagattcacatttagtattctatgttaatacaaatggacgttgtactgctgatggtggttttgtagttgatgatggagatgcaacttataaattagatagaaatggtcttaccatgactaacgaaaatggttatacaagcagaatttatgtagcagataacgctaccgaaatagtagcagatgatgattttactataacaaatactttaagagtaaaagacacatctaggtttgatagatatgctaagttcttagaaaatgttgatgttgatggggatttgtatgttgatggcacattaacgataaacggagattctttggaagacataatagatgcgcgaatacatgagttaacatagagaatagttaataaagcaagatatagtataggggtgaacacatgagtaatgaagaattagtcttattataccaacaaggcaatataaaagccttagagagcctaattgaagccaatgagggcatagttaaaaagctcgcaaataagtttaatggcattaataaaatgattgaatttgatgatttagtacaggcaggaattattggactaattaatgcagctaataaatacaataatgaattagaaaataaggccagcttcattacttatgcttttcaatatataaaaagagaaatattttcatgtgttaatggaagaagtgaaaaagaaattagtaataataaactttataatagttgtgtaagccttgatgtacctatacaggaggataatgatatacaattaaaagatactattgaaagcattgattatggctttgagaatgtggaagaaaagatttatattaagcaattaagggaagagttagaggatgcaatgttagataataatactttaaaggaaagagaaatattacagctatgttatgggtggaattatcaaaagatatttacatataaggaagtagcggaaactctaaatataagtattaatagtattcctcaaatagaatttaatgcattaagaaagctaagaaatagtacctggggcaaagaaaaagttaaggaatatatgagagataaagtagaatctataatggaaagttcaaggtataatcaggataaagttatagataaaattaatctcatagataagtattttagtggggtgatataaatggatctaaaggatatatttgaacagactaagaaagatttaaaagagttcaaaataataattgatagattgaaagtaaataaattaaaattagaaaaagaagaattaagtgctgaagaaatacaattattacaaagaaatattaaatcagatgaaattaagataaaaaagataaaatcagcattagagtttttgcaggatacagatctaaaaataataacatctatattctttgaagaagtaactaataaagatatggcagctcaattaaatgtatctaaagagtttataaatagacataaaagagaatcagttgaaaaaatagctgatataatgtgtggccatttagtaggaagtaattttagtagttcttatttacaggattaaaattgaaaataaaatcacatggagcggttttagaaactatataatatgattctgttataacatctatagaaatataggtgtttttgtattagagtagagtatattttattaacataaattaataggaaccagataaagaaagttattctatattagctacaatcatgctataattaggcttagggcttgaacattttctttggctattggataacagatagttaaaggagaggataaggcgatggatcatagtctattaacaagtggtatgttattgcttgcgtgtatagtattaaagaataattatgtggaattggaaatgaattttagtaaaaacaataagagttttaaaataattttacaatcaaaaaagagtgcggtataagcactcccttaaaaattagataaatcatccaatggccaagatcacgttcgagtaccaatggatcatgcttagtgttcgcagcactaagcttttctttttatattagataaattataagcaacttatcagctattaagcttataacaagtattgctttccagtacattatatcaaatatgaaataaaatataaataacttgtttttataattatttatattttgtttgcatgtagctttaacaaagaaacttgattaagaacttttataggaattttaatatattttactacatatttgtaatttctagaaggaatataccaacttttgtataattgtattatatgaaaggtgggcttaaagagtggaaaaaaataatcaagaatacttatgtaagtatatgacattcgagcagtttttagatttgattgagttggaaagattgtacttaactaatattacaatttgggatgattgctatgaaggatatgaaatagaaaaatttcaagaatataatttatcagacactaaaaataaattaagcaaagaatctctagaaaaattgaaactatggaatgaagttaaaaagaaactatattatgctcaatcgtggactaaattaattgatgaatcagatgctatgtggagaatttacagcccacaaaaaactggtgtaagaataaaagttaagaaggacaatattataagtgcaatattagaattgatagattctgaaaaagatatttatttagacccgtgtagtggagatatagagtatgaaaaaccaatagattatgaagcatttagattaacggatagtgaaccaaaagaaactagcataaaagcatataacatatccgaaatgccattgatatattcaaaaagaaaagcatttatacatgaagaagaatatagattctcaataaaattaaatttgtccaaaatagtagctcaagtttgcgaaaaggttactgatgatggcggtggagcggaaaatatgaagaatttatataattatgattatccaaaggtaatacattataaaatggaaaatgatttaataagtgaagttcttttggatccaagagctccaaaatattttgaggaagcgtttattgaatattgcaataagagaaaatttacagataagaatattgtatataaaaagtctgatttatatacaaaagaataatgagtaagtttaagaactttagaaatagggttcttttattatgtaataaattaaaagatattttatttctttcttttaccatgaataacattataaacagtaccaatagatactcctagataatcagcaatttttctatagctatcaccacgattatagtaaaacttaatagaattttccagagcatcaatgcttggctttttgcagctacgagatccagtcttatttctttgattttttaataatatagcttcaggtgtttcatacaatccgagaaccatttctacaagatcatattttgtaatctcacggcatctaccacaaacttgaatacttttgtttttaatacaattatcacataccataatatcccctccattatgttcattttaatacaatgaacgattatatttaattatcgaaagataatattagaatataatatttaaaaaatataaaaaattgtttctataaattaattggaataattgacaaaaatatgaggtgttatacaattatgttatataaattgtataaggggaatagtaatgaaaaataagcttatagcaagtttattatgtggattattggcaataggagttttcccaataggggcaagtgcagaatggatacaaaactcagataattcatggatctggacagaaaatgggtttaaatcttttgggtggaaacaaattgatggcaaatggtattatttcaataatggtaggatgcaaacagggtggctaaatataggatataattattatttaggcaatgatggaaccatgaaaacaggatgggttagtattgatggagcttggtattattttaatactagtggtgtgcttgcaactgatactgttgttgaggggtactatgtagattctaaaggtgtaatgcagcccaaagaaaaacaaaaagttttagttgataataagtatgtaaagattacttatcttggagctgataaaaatagtagttattttaaaaaggtaagtttacaagtagaaaataagagtaatcagaatctaataatacaaactagaaatgtttctgttgatggaaagatgatatatggaatttatagccctaatataactccaggtaaaatagatacaagtggaatcacatttaatggtaatgatattacaaccgcatttaatcaagtagaaggaaagttcgcaattataacttctaattacaaaactttagaagaagaaaatttttcgatagatttataatttttaggccagtaaaagctggtctttttttgtgtagtagaatagatattcttatcatttataatgaaatatttatttgagttatattacaaaatgttgacattagtatcacaaaagtataacattataaacaataataacgtgaggatatttaaaaataaaagtcgtgtaaaggcttagaaatactacgttttaagcttgtaattttgaaatttgcgcctggaaagcgtgtataggggcaactctatcaggggttcaaatccccttctctccgccaattaaaaaacgaaatataaagaatgcctgagaatttagtaatactaagctctcaggcattctttatatttagatagttattgaaaatattgtcaataactatagtggcttttgtatgatgatgaatctatggcaaataatacagttataaatgtatataatttaattacagatatttgtctaaatatctgaagaacacatattccattatggcattcgctgttactctggatttgaatttaatgctgtttatttcatattcacttgagaatatgaaaaggcatttatcagataagttggctaatgtattataacctacactggtaacgcatatgattttacagcctcgtgtttttgctatatttactgccttgattacctgggaggtttctccggacatggatatagcaataattagagttttactatcaagatcgcttgctgtagaatacattatgctggagtcgttaaaatatctgcagtttttttctacaagatgaaattttcttgagatatctatacatacatctttagaggaaccttccccgtaaaaatctattttttcagcatcgtggattatacttattacttcatcaatcagagaatcattgattaaatctttagttttagcaatatcatcaaataaaaacatattatcggatatttttttatgattattttctctatctattgaatttctcaagtttgctttaaattcagagtatcctgagtaagataatttattacagaatctcactattgttgcagtggaagtaaaggtttctttagaaagatcttgaattctcatgtttgataccttttcaatgttttccaatatatatttaagtaaataattttcatttttatttagaaattttctatttttttcaatagtatcaaatattgtcataaagtgcctccttaaaagaatatcacaaagagcagaaaattggaaacatcacaaaattttgcaccattctagtaaaagaaatatgatgttgtgtgttactaattataacacacaaatgaaaatattttcataaatgtacattatactatatgtgaaaaaattttctaaagctgtttaaacccttctcttattgataatatcacattatactaaaagtatcatgaatggtaccacatgaaagagtgttaaaatttctatgacaagggattaataataccttgtacagtagatatataaggggatgttttagatgaaaaaattcaatgtatcattagttggtggaggtagtacatggactccaggacttctcgcaagtttatgtaaattaaaggacaggtttcctataaatagattgattttattcgatatagataaagaacgtcaagaaacaattgcaaattatgcaaaagtattgtttaatgaaagataccctgaattggattttagatacactacaaaggttgaagaagcttatatagatgttgactttgtaattatgcaaatgagaaccggtggttataagatgagggaaaaggatgaaaaaattcctttaagcttaggcgtaatagggcaagaaacctgtggtgctggaggatttgcgtatggtcttagatctataaaagacatgattaaaacaataaaggatataagaaagtattctaaagatgcttggatattaaattatacaaatccagctgctatagtggcagaggcattaagaagagaatttccagaagataagagagttttaaatatatgtgatcaaccagttaatttattacgttcttatggcagagttttgggaaaagattcgaaaaactttgaaccagtttattttggattaaatcattttggatggtttactaatttatatgatgaaaatggaaacgatttggttccagaacttagaaaagtaataaaagaaaggggatttattcctgtagatgcagagcaaagagataaatcatggttagatacttatgcaatggtacaggatatggttaatgatttcccagaatatcttccaaatacttatttacaatattattattatcctgattataaagttagtcatttaaatccagattatacaagagcaaatgaagttatggatggaagagaaaagagagtttttgaagaatgtagaagagtcgctaaagctggtactgtagaaggttctgtgatggttcataatgatgcacacagtgaatttatgatagaagtggctgaatctattgcttataatcttaaaaaaatatatatcgtaattgtaaaaaataatggaataatttcaaatttagatgatgatgtaatggttgaagttgcttcgataatgacagcaaatggaccaaggcctctttcagtaggtaaaatccctacattttacaaaggtctaattgaatcacaatcagcttatgaaaaattaacagtagatgcttattttgaaggttcatatgaaaaagcgttacaggcattaactatgaacagaactatcgtatctgctaaaaaagcaagagcggtacttgataaattaatagaagccaacaaggagtattggcctgaatttaaataataagatttaaatagaatattggtatattaaaaaacagtaccaatattctaataaaatatgaaataattattatattaggaggaagaataaatgacaaatacaagctatttctctaaatttcaacaattaggaaaagtattaatgaccccaatacttatattgccaattgctggtatattaatgggaattgggtctgcatttttaagcccatctgtaatgaaaacgatgccttttttgcaaatgccatttttcaagttgttttttagtttgcttaaatcatcaggatcaattgtatttaataatttgccggcaatctttgcaatatcaataactataggttatgcaaaaaaagagaaaggtattgcagctttatctgcttttttaggatatatggttatgaatgtaaccatgagcgccttacttattaatcttggtaaaataaacccagataaactgcttgtaggacaatcaaatatactaggagttccaacagttgatacaggagtttttggtggaataatagtaggatttttaatcgtttatctacataataaatattataatatatctttacctcctgttttatcaatatttagtggtacaaaatttgtcccaatggtttctattatcggatcattaattttaggattagcattgtctgtagtatggccttttattcaaggtatattaattgaattaagtatattaattaaaaactctggtgcttatggatctatgatatacggtctagctgagcgagctcttcttccttttggacttcatcattttgtatatcttccatttttctttacaagtcttggtggtagtatggagataggtggaaaagtagttgaaggtgctgttaatatttatcaggctcagttagctactccaggagaaatgtttaatattgatgtcactagatttgctatgaatggtaaagttatagaatctatgtttggattgccaggggcagctttggctatgtataagtgtgcaaagcctgaaagaaaaaaagttatagggggattttttcttgcagcagtaattccagccttcttttctggaattacagaaccaattgaatttgcatttttatttgtagcaccagcattatatggaattcatgctatatttgcaggaactgcttatcttgtaacttatttgttacaaattaatatacctggaagtgcagcttttggtggacctttcttaagctttatatttaatggaattatgcaatcagataaaggttctcactggatatttgttcctatagtaggtgtaatatatttttgtttatactatttcagtttcaaatttgcaataaaaaaatgggatttaaaaactccaggacgagaacttgaagaagattcagaagaaatttcagtagtttcatcaagtaatacaataattaatgatatagtcgatgcacttggaggaaaaaataatattaaaagtgtagatgcctgctttacaagattgagggtttctgttaatgatatgtctatggttaaagatgataatatatggaagaaacttggtgctaatggagttgttaaggttaaagatggtgttcaggtcatctatggagcaaaagctgatgtttataaaactcaagtaagagatttacttggaatggaataggtgattatatatgtttagtaaattatttaagaaaaaaaatgatattgtaatatattctccgataaaggggaaaattgttgatatttccgaagtcccagatccagtgttttctgataaaattatgggtgaaggtattgcagtaattcctgaagataatattatatgctcaccagtaaatggttatgtagctcaaatttttaaaactaagcatgcaattttactaaagagtagtgatgatttagaaataataattcatattggattagaaacagttaatttaaatggtgaaggttttgaagtgttaataaatgaaggtgacgaagtaactacaggtaaaaaacttataaaagtagactttgagttcatgaaaaataaagggattaatacaataattccagttgtcataattaatcatgcggatagaaatattattaaatattttggagacaagcaaactggagctgagataatgaaaatctcacaatagccaattaatatggataataaagggaatagtgtgcaattcaagtctaataataagatttgaaattatagacctgtttcccttgttatgtaagtgtatagataactagcacaactcgttaatttatatatctgtttataacatattctgcatcatcagataattttaggtatgtgcgtaaaaaatgatttgaagttggttagttaaaatagggagaattgaatcatgaagtagatttagtttttaacataaattatttctatcatcagttaaaactgaaatatatttttcggagtgttcgtgatgatggaaaaaggaataattgaagagttaaaaaacaattaaaagaagaagtgatgactgagataaaggcagaggtggcaaaaaacaagcagattaaaatatgagataaagaagatttaatgaatatgtttaagatgggaagaacaaaatttaaaaaattatagataataaacaatcgcctattaaagttataggacaagaatgctatgtgactaataataagttacaagcgtggttttatgactttgagggtatgaagattgatatagactaaccgtagtttacctcaaaagattgtaatctaccatattttttgtaatcagtattgtaatcaaataatgaaaaataggattgaaagctttggaaaaactaaggttacagaaatgacgagaaagctttcaaatccccttctctccgccatgaaataagatgtgaagaatgcctgagtgctaagtaaaactaagcactcaggcattttttaatatttttaagttgtccaaatcatacctcaaactaccgtataagacgttaattttccagctatattctaatcaaaatagggtgatgcaaccaacgctttatgcgagcgtggatgggagataatactacaataggttgattagtcaacttgacgatgataaagtattgttgactaatcaattatattgcaatatgataagatgataaattttaaaagtataaatttgataatgtttataagtaaatatggacaatgagctgttatattatcactttgtagtaagagatcaattaccatgctttcaataattaaaaagattattcaaaagtaatttatataagtctgttgtgagaacgggttgtatgatgatcaagattatgtgaatataaatagaatatttatattatatgaagtaaaattgttccactataaacgttgacaagtcaacacagtgtaaatataatatagtagactaatcaattatattataaggagagaatgattatggatgttgaaagcatgaacctcataatgattacaagtaaaatttttagatataagcaaatgtatttagaaaaggccttaaaaaaatatggattaagcagtggttccagcccatatttgtttaatcttgaaggaaacgaaggtataagccaaaacggcttaagcaaagaacttggtaatgacaaggcaatgtctgcaagaacaattacaaaattagtagatcttggttacgtttatagagaacaagatgaaaaagatagcagatcttataaattatatctaacagagaaagctaaagaagtattgcccaaaattcatgaagatgttcaaacgttgatgagtttaataacagaagatgtatcagaagcagaaatgttaattacaatgcagtctttaaagaaaattctaatcaatatccgaagattaaacgaatttgagaattaaggtaatatggttatgtaagttaaatattgacaagtgacaagggaggaaaatttatggaaaatataaaaaatagaagcaaatggtccatattagtaatagttttaatgtttacagttatgtctgctctagatggtagcattgtaaatgtagcattacctaaaatggctactgctttaaatgtaacaacatctagtatacaattagttgcaacaagttatttaatagtaattgctgggacagtattgatttttggaagacttggagacatgcttggaaaatccaagatgtttacattcggattaggattatttacccttggatcgttactatgtggtataacaaattcttttccaatacttattttagcaagaatagtacaagctataggcgctgctggaactatggctaataatcaagggattattacagaaacattccctccacatgaaagaggaaaagctcttggatttttaggtacttctgtagctttaggatctctaataggaccaggacttggaggactaatagtaggcgcagcaagttgggaatatatttttttgataaatgtacctattggagtaatagcattattttatgctattaaattgttaccgaatgggaataaaacagttaagggaaaattagatatcttaggagctgtattatttatgtttgcaatagttccactctttggagctttagatgaagggttgaatattggcttttcagatccaatgattttattgagctttgccatcgcaattgtctcatttataatatttatttttgtggaaaagaaaaaagaagatcctctattacaattaaatatatttagcaataaattattttctttaagtatattttgtgcatttgtaacttttgtggcaatcttctgtaacaatattattctgccattttaccttcaagatgtaatgaattatacaccagaacatactggattaataatgatggtttatccattactcttaactgtagtagcacctcttagtggaagcttatcagataaaattggttcagagcttttaaccttcataggtttgatacttataagcctaggtttaatattaatgtccactttaaatgtaaattcaactgtaataatcacaataatattcataggaattatgtctattggtatgggattatttcaatcgcctaataattctttgataatgtcaacagtaccgaaagagaaacttggaattgcaggaagtgtaaatgctcttgtaagaaacttgggaatggtatgtgggatagctttagctacaacgcttttatatagcatgatgagttctataattggataccgtgttacagatcttgtagcagggagaaatgatgcttttatatatgctatgagaactgtatatatagcggctgcagtaataagcttaatcggtgctgccttgacttttttaagactaagaagtaaaaagctgaaaagctctaatatgcatttggagcaccagtttaaagtttaatatgaataaaggtaaatatatacctttattcatagaaacatatttaaaaagataactatattcctatgtaactataaatatatgtaaatatttataggacatataagagcttcagacatcattgtgtaaaataagagtttatgaaatataagctcttatttttttggtgtgcccagcatgggcacgtactaatcggtgaaagtccgtaatgggggctgatagtgccataatcataattgtaaggaatatacgaacatatgtttgaaattaatatatttttattgtataatatggataaagtataaatttaaggaataaggaagaacgaaagctatgggtataaagagtgaacttgaaagaactagagaggaattaaatatattaattaataataaggaaataattacaaatgataaggaattattagagcttagtataaagttagataagttgattaatgaatatatgaatagtattaataaaagtatttaggtatttttttatcgcaaaaattcgaactgatgtttttatattatctgtagattagtatctttaaatcatatagttttatgaagatataaaaacaatgatattagccagaaaataataaaacatgttcttaccatttgcacttaagtgaaaatagcaaggcatgtttttctcttgcaagtgtaatattagaatataaaggctttacaaatttataattttaataattcatataaggataaaataaagtaaaatagtccaagtattaacccaagagaagaataacttttaatttttatatcagtttttttagatttgattaaggatatcaaactaattattatagtgacagttgggataattattatataacgatttaggatggtattcaataatccacccatagtgaataatgttaagcctaacaatgcccccactaaagaaagtctagtgtttattttattcgattccatttaaacacctcctattacaattatatccattatgataggattttcaacgctaatttatgaaatttattatgaaaggtgaatgtggaagttacgagccattgattgagcattaactagtgcatataaattactatgatgaaaaaaattataagctttttaatagaaggaataatactatatggaatatatggttttatattctagtatatttaattttatattacacacaataataactgaaagaggtggttctcatggacattgattttaacaataatattttaggattagtccgaaaatgattttaaagtccccataagtacacttgtttcgaaacagaccagggtttaaaaataaaccctggttttattttgaagtatcagagaagattgtctgatcaagtatatagattgcatacgttatgaattagctagattctaatggagctcattccaataacctttgtttgcatccattaaatcttttaataattctttagcaatattagtatttacaactgtacgatttaatacaagtgcctgtaatgctttttgatagcttccttctaagcacgcgtccactgataatttttcatatgcatattgattttccataagtcctttgtaaaaagtaggtacacttcctacggctaatggttcaacaccattacttccaacacggcatggaacctctaccatcattccagatgaaacattttgaatagctccgttattttccgtaattattaagaagatttcatttgtattatttgcgattgctgttgctaaatcaactatatattctgcatggcatcccacatcactggtgatttcatatttggtaccatgcatcgtacctagagaaataatttcacgcaatctttcgtaagtttctttttcatttccatccattacttcattagcacgtgtgtatttgggattttctttatctctcattttatttgggtataaataatattgcaaatatgtgtttggcagatattcatcataatcattaatcatttgactcataaagtcaaaggttgctttccatgaaggttctttaaaaagaggttctgtttgtacatctactggggtttttaatatttctcttaatttaggtaaataatcctctccggtctttttatctaagatattggtgaaccagccaaaatgatttaaaccaaaatatttaggctctaaatcttttctttttaagccaagcacacttgcgtaaatgtccatgattgcaattggcatatcacaaatgtttataatacgatgatcactaggaaatactctctttgttgcttcagcaacaattgcagctgggtttgaataatttaaaatccaacattctggagaataagtacgaatattttttattatgtcaataacagcaggaacacttcttaatccataagcaaatcctccaggaccacatgtttcttgaccaagacatccatgttttaatgaaattttttcatctttttcacgcatttttaatcttcctgcacgaatttgcataagtgcaaagtctatatctttaaaggcttctttttcatcagtagtatatataatttcttcgagttctggataatattccttaaataagatttcagcatattttccaactatactttgacgttcactttcattatcatataagataattttccttaaggggaatctatctttttgattacataacattgcgagcatatctggtgtataacggcttcctccgccaacgatacagattgaatactttttcattttacattactccttttagttttatttttttgtgtttaatacattaacaagtttttctttttcagattctacagtcattccaataataatttgtacgttattccctttaataacgacacctttttgttttgctttactaattatttctttatctactttgttaatgtcacttacatcaattcttaaacgcgtaaagcagttgtttacttccacaatattttctgcaccacctagcccttcaataaataattcggcattttgattgttaggattattactttcaggggagtcacagattatatcattattaagagattcttcctctctaccaggtgtctttatatcaaattttttaattaggaaaacaaaggtgaagtaccatactatagccattacaataccaacggcaaagaaaatgtatatcttagataactttggatctataacagaattgcaaactatagtatcaagtaagccatagattgaatatgtccttgatcctaatacccaaagtagcatttctgaaaagccagtgagtaatccgtgtactaaccaaagtaatggtgatataaaaagaaatgagaaatcaagtggctctgtaatacctgccaccattgaaacgaagagtgttggtataagcaaacctttcacagtgcttttattttctgtttttgcagtttttatcatagcaagaactatacctaagcttgcgaagatttttgcaaatccaaaagtagcaaatcttatcgaaggatcaatagctgttaaattagcaccactacccatttctgcatagaaaatgtttacggcgccttgaacagtattaccatcaatttgggaagttcctccaaatccagtgaagcaaaatggcatccataataaatgatgtaatcctgttggaattaaaaatctgttaccaaatgcatatacgaatactcctaatgcgcctgcgcctttcatgaatattgataaacaagaaatgccataatttataacaggccatacataactaagtacaattgctaatattaaagtaattggtatcataattataaatacaagtcgtgatccgccgtatactcgaaacatttctacgaattgtatattagacgctttattaaacacgtatccagtaatacatccaagtattatgcctaaaaatacattcatatctactacctggaatcctaaaacaaggttttgcccagttccaaataaccccatggcgccaggctgagctagcatattttgtgaagtaagccatgcattgtttccagccaaaaatataatgtacacaatcagactaataatagcagcgtccacttttttatttttagcaaatgcggttgttagtccaacacagaaaataatagaaagattatttaacatagcattcatcatggtctttaataaagttccaataaaaatcataaatgatggcataaagctgagttgcataatgacagcaatagcgagaccagttcccatgattgctaaaaacattacaggttgaactgcggcctgtgaaaacttttgacttaatgataataatttttctttcatataatatgtacctccttttatttgtctttagaatacactagaatatatagagtatcaatggaattgccacttctatgataatgtttacttttagtgaaaaagttcactgaactacaaatataagaagatctgttagaagtgaacattgtaaagagttttacaaagtaatctacttttaacagacctttcatggagtaaatatcatatttaattgagtttatagacactagtttctttgtggcgataaatatttattagaatatttgcttaatgctaattctaataagattattaaatttgaagtgaaaaaattaggtaggtaatgctctttatctgattttgttccagcaacctctattgtcatatgagctattttgcccaatggagaatctttagttgaagtaaaggctacaactttaaaattattctctatagctacgttaaccttttcaagaacttctgaccttgccccagaataagaaagaaaaaaataaagtccagatttattcttactgaatgcttcgtaatgatagctgctagcggcatcaaatccaaatgataataatttttgtaagtaatattccttagcactgtcgcaaaagcctagggaatcaagatagattcttttttcgctatattctcttagtaattccacaagcatattaacatgaattgttaaagtctcactttcataagtactaacaatattattcgaaaagtccaatttgagtgcattattagtagaggcaagaattgtataatacatttcactatatccgctgtagccaagtttcttcgataattttataattgctgcttttgaaacaaagcattcttgtgcaactccatttattccaaccctttcatttttgctgatatgctcatgtattttattcaatattattttttcaagctctgagaggtttatattactttgcatttttaacacttcccgtctataaaaataattcttatgcgtataaaattacttttcctttagtatatcattatgattaagttaaaatctacataatagataaaagagtaatcttatttatagacgtttgagaatactgaaactgctattatgtggtatttaattaactgtagattaaaagtttctataagtttttggagtcatattcataatcttaagaaagtttctattaaatgaacggatgcttgagtagccacatttataagtaatatcagtaatcgggtcttctgtattttttaataaatatgctgcgtaattaattctattttgattaacaaaatcaacaaacgatattccgagtacattatttaaatatttggataggtaattgtaactgtagcaaaattcatctgcaatgctttttaatgagatatctttagtaaaattattttgaatatagttaaggattttatgtaataattcataatcatttttcacgcttacaagtaattgcgtatgttccataacttcagaacaaagcaaataaagacaagctttcatctcgagaacattgacattatctctgaaaattttgtctagtataagagctcgcgcgttatgtgataaattaaagactggattttcgagaaatttaccatagaccatgctgtcaaatgtttttacatattcaggggaaaatatgcaaatacgagcatcagagtacttattagttgagagagagtggatttcgtaaggcaaaattaatatgcattcatccttttttacttcaaaatttctattattaacagaaatttgaagatctccatcaataacacatatgaactcgaagcttcgatgtagatgaacagggtaattaagactaattggatggtagtgggaaaaaagagtgttttctccaaagtggtgcgactcgtattttaacatagaatacctccaagagagtaaattttgtctacaattatataaatactttcttgttaagtcaaccataaattttatattattaaattacaaattgaatattgtattatagattttaatctccataaatatttaaggaatagagggatatagatgaatggtgagcaagaaaatactcatgaatttgcagtaaaggcagcaaaagaattagtatctaagatgacattacaagaaaaagcggagcaattaacttatcaatcaccagcaataaagcacttaaatgtacctgagtataattggtggaatgaaggtcttcatggggtagctagagctggaacagcaactgtgtttcctcaagcgattggtttagccgctatatttgatgatgaattcctgggaaaggttgcaaatattattgctacagagggacgtgctaaatacaatgaatacagcaaaaaagacgacagaggcatatataagggattaacttattggtctcccaatataaatatttttagagatcctagatggggacgtggacatgaaacttacggggaagacccttatttaacatctagattaggggttgcattcataaaaggattgcaaggagaaggaaaatatttaaagttagctgcttgtgcaaaacattttgcagttcatagcggaccagaagggttaaggcatgaatttaatgcggtagttaacaagaaggatctatatgagacatatttaccagcatttgaggcatgtgtaaaagaggcaaatgttgaaagtgtaatgggagcatataaccgtacaaatggggagccatgctgtggtagtaagactttgttgaaagatatcttaagaggcaaatggggatttaaaggacatgtagtatctgactgctgggctcttgcagattttcatttacaccatatggttacaagtactgcaactgaatcagtagcattggctatagaaaatggctgtgatcttaactgcggaaatatgtatcttaatttgctattagcttataaagaaggtttagtaactgaagaacaaataactacagcagcagaaagattaatgacaacaagatttaaattaggtatgtttgatgaagagtgtgaatataacaagataccatatgaagtaaacgattctagagaacataatgaagttgcgttgatagcatctagaaaatccatggtattactaaaaaataatggaacgcttccattagataaatcaaatttaaaatcaattgcagtaattggtccgaacgcaaacagcgaaataatgttgaagggaaattactctggaacagcatctaagtatacaacaatattagaaggaattcatgatgcagttggtaatgatgtgagagtatattactctgaagggtgtcacttatttaaagataaagtggaggacttagcaagaccagatgatagattatctgaagcgatttcagtagcagaaagatctgatgtagttgtattatgcctaggattggactctacgattgaaggagagcaaggggatgcggggaatagctacggggcaggagacaaagagaatttgaacttgccaggaaggcaacaaaatttacttgaaaaagtacttgaggttggaaagccagttattgttgtccttggagctggaagtgctttaacactaaatggtgcagaagaaaaatgtgcagctattttaaatgcatggtatccaggtagccatggaggaactgctgtagcggatatattatttggaaaatgctcaccgagtgggaaattaccagtaactttttataaagacacagctaagcttcctgattttactgattattcaatgaagggaagaacttatagatatttaggacatgagagtttatatccatttgggtatggtttaacttattcaacagtagaattatctaatttgcaagtgccttctgttaagcaaggttttgggagttttgatattagcatagagattaaaaatactggggaatatgatattgaagaagtagttcaatgttatgtaaaagatatagaatcaaaatatgctgtattaaatcatagcctagcaggattcaaacgcgtttcattgaaaaaaggagaaagcaaaattgtaacaataaaattgaataagaaatcattcgaagttgtaaatgatgacggagaaaggcttcttgatagtaagaaattcaaattatttgtaggggtatcacaaccagataagagaagccttgagcttacctcagtagcgccattggaagcaaatattgaattaatatagagatttaaattatatattaaagagacaaattataattataaaaatgtaagttagtatggaaataaatattcaaagaaaagataggagagaatcatatgaaaaatattgcaaaacaaaacgagcctctagtaactcatatttatacggcagatccttctgctcatgtatttgaaggtaagatctacatctatccttctcatgatcttgaccaagtacagatttcaaacgataatggtgatcaatataacatggaagattaccatattttatctcttgatgatactaattcaccttgtatcgacaatggagaagcactgcacttaaaagacattccatgggcaagtaaacaattatgggctccagatgctgcttataagaatggaacttattacttgtttttcccagcaagagataaagaagatatctttagacttggagtagctactagtgaatctccttctggaccattcaaagcgcaagaaagttatatacctggaagctatagcattgatcctgctgttttaatggatgacgataatagatcatatgtttattttggaggcctttggggaggacagctagaaaaatggcaaactggcacttttaatccagatggagacggtcctgctgctacagcacctgctataggaccaagagttgctgaattaaatgatgatatgcttacatttaaagaagctccagaggagatatcaattgttgatgaagatggaaatcctatacttgctggtgatgaagaaagaagatattttgaaggaccatgggttcataaatatgatggaaattattatctttcatactctactggtagcacacatttcatagtatatgctatgagtaagaatccaaagggaccttatacatttaaaggaaaaatacttgatcctgtaattggttggacaactcatcactcaattgttgagttccaagataaatggtatttattctatcatgatagttctttatcaggtggagcagacaacaaacgttgtgtaaaatacactgaaataaagtacaatgatgatggtactttacaaaaagtagagttatcttaataatctaaattataataaatatgtatcttgaaagtttatagaaaggtacttcatatttgaaattcaccctgtcaagtagacaggagaaataatgaaaaattatgatgctaaggtctgatttcaatagtccattggagtcaggccttttaatattttatatagtctgtttatgtataaaattcttaacttaaggaggagaattatgttaaaaattaaaaacccaatcttaaagggctttaatccagatccatctatatgtaaagctgaggacaactactatattgcaacctctacttttgaatggtttccaggagttcaaattcatcattccaaagatctagtgaattgggagcttatagcacatccattgaatagagtctctcagctaaatatgttaggaacccctgattcaggtggaatttgggcgccatgtttgtcctataataaaggtatcttttacttaatatatacaatagtaaacaacaatggacatattaaagatacccataattatctggtaacctcaagtgatatttgtggtgagtggtcagagcctgtttatcttaattcgagtggttttgatccatctctattccatgatgatgacggaaaaaagtggcttataaacatgaaatgggataatcgtataggaaagaataattttgctggtcaccttttacaagaatatgatgaaaaaaacaaatgcctcactggccctgtaatgaatatttttaaagggacagatttgggttgctctgagggtcctcatatatataagcataatgattactattatttgatggcggctgaaggaggcactagttatgaacatgcagtaacacttgctcgttcgagaaaacttacgggtccatataaggttcatccacaaaatccaattcttacttctgtgggaagtgatatgcataaagttcttcaaaaagcaggacatgcaagcattgtggaaggtcctaataatgaatggtttatggttcatctttgtggaaggcctcttcctgaaacagatcgctgcattctaggaagagaaacggctatacaaaaggtggaatggcgtgaagatgattggctttatctatgttctgacacagataacttaccttcttgggaaatagaaattaacaatgacagtgaaagtgaatcaaataatgaagaagatgtcttagtttcacagtatgacgattttaataatactttattaaatataaattttcagtccttaagagttccagcagatacctttatgtcacttactgaaaggccaggatttttaaggttatatggaaaagaatcaatgttttccaagtttacacaaagtatgatagcaagacgtcagcagaactttgtttattctgccgaaacctgtgttgaatttgaacctgaaacaacgttgcagcttgcaggattaatttgctattacaacacagaaaactattattatttgaggataagcatggatgaagaattaggaggcaaatgcataggggttctagctagcataaataatgatttatcagagtccatgactcaggatgataacatcttgataactgatgtagaacgtatttatctaaaagtggaagtgaattttgggcaacttagatttttctttgctaccaataagaacgagtggaggcctataggcaaagtttatgacgcaagtacattgtcagatgatgctatcaaaggttcatgggctttcaccggtgcttttataggaattgcgtgtcaggacttatcgggtatgaataagtatgcagattttgattattttttatatgtagaggggagataagttaaaattccaattgcattatcataaatggttcatatgtcaaaacaggtggtttcaatatagatttaaaccacctgctaatatataatatacggagataaataagaagtattttaaaaatttatttatcaagtttaagttgatcttcgccccatacatataattcctttaatgtaggaagtaaggcttttcctctttctgtcaaagaatattcaaccctagggggaatagtttcatattgagttctaacaattagcttatgttcttctaattcctttaaggactttgtaagcatcatgttagtaacacctttaacttttcgttttaattcattatatctagtagaatctttacttgataaataccacatgataggtaatttccatttttgacctaaaatatcaagtgcatatataacaggacactctgtttcatagatattatcatcagggaattctttattataacgcatataatcactcataagtatagctcctttgaatcttatagtatactttttatactgacacagaaaaaactgcatacttgtatatttatacctttatgttatattgattataacagaaaaataaaacattaaaaagaggagtgttatttgtgaaggtttatgctatcaatggaagcccaagaaaaaataaaaatacggctacattacttcaaaaagctttagatggagtgaaagaagctgcaaaagataaagaaattgaaactgaaatgattaatttatatgattataactatactggatgtaaaagctgttttgcttgcaagaggcttggaggaaaaagttatgggaaatgcgcagtaaaagacgatcttcaagaagttttagaaaaagtatctcaagctgatgggattatttttgggtctccagtatattttggggatataacaggtcaattacgatcatttctagaacgattattcttcccttatttagtatatgataataatcattcttcaattgctccaaagaagatggcaacagcaataatttatacaatgaatgtaacagaagagataatgaataaatctggttacttatcaacctttaataatgtagaaggagtgattgaaagaatatttacaaaaccattagttatgcattcaaatgatacttatcaatttgatgattactcaaaatataaaatggaagtattctctgaagaagcaaaagcagaacatagaaaaattcaatttcctttagattgtcaaaaggcatttgaaataggggctagtctaataaagtaatatatataagtttaatcataaaacattttacaaagtcataatagatgaggtataaagatattaacttaaatgaatggagatgtatatatgaaatttatagaattagctgccaaaagatattctgtaagaagttttgatacaaagaaaatcagtcaggaggatttaaatttaattttaaaagcaggacaattagctccgactgctgcaaatcgtcaaccacaaagaattttggtacttgaaagtgaggatgctcttgctaaactacaaacttgcacaatttatcattttaatgcaccggtagccttacttatatgcgccgataaaaatgaagcatgggaacgcagctatgacggaaaagtccacactgatattgatggaagcattattgctacgcatatgatgttacaagctgctgaacttggagtaggttcaacatggggtggtcattttgatcctgcggctatacgtgaggcttttaatataccaacaaatcttgaacctgtatgtcttttaccaattggttatccaagtagcgaggctaagccaaatcctaaccacgaaaaaagaaaggatatttccaaaactgtcttttacaataatttttaatgtatgatttatttattaggataatttaattgtataggaaattatagaatttttaagagtttaaagctagatgaaatctggctttaggctcttcggtatgttaagaagtaactataaaattaagaggtatacaaatgaaaaaggataaaataaataagatactagaagactattggaatagttttgtgaaattgtatggtaaaagcaaaaataaagaaagcccgacgtgcaagccgggctttaaatatgtgcaaaaaatgagctactacaaacttagttaattacttttgtagcagctctttttattttaattcagtaaataagtactttttaaaacttatttaataagtaaagatttcaaatgtagaggtaaagatattacatataattaattaatgcattactgtaaaataacaaatgtaaacgatgttaacgctttgaagatgagagtttagcaaacgtattcttagagatttaataactttttaatcattatttaaaaagtaaaaatttcaaatgtagaagtaaagatattaaatataactaactaatatattattgtaaaatgttcatgaaaacgattagtgaaagttgaggtggttagaattgagtaatgtatttttagaaatgaaaaatatacataaaagatttccaggagtttatgctcttaagggagcacagttggaaattaaaaaaggtgaagtacatgctttattaggagaaaacggtgctggaaaatcaactttaatgaaaatacttgggggagttcatacacaggatgaaggtcaaatatttgttgaaggagttgattgtggagttattaatccaactaaagctgcacaattaggtattggatttgttcatcaggagctaaatctagcagagacattgacggttgcagaaaatgtttatatgggaagactaccatataaaaatgaagccttgggtattgttgactacaagaaattacacgaagatacagattctataataaaaaaattaggaatagatataaaagctactgacctagttatgcagcttccaactgcaaagaaacagatggtagaaatagcaaaggcaataagtttaaatgcaaaagcgattatttttgatgaaccgacaacatcgttatctcagaaggacgttgaaaacctttttaaagttataaaaacactaaaaaatgaaggtgttgcagcaatatatatatcacatagattaaaagaggtttttgatatttgtgatagagctacagtactcagagatggtacttatattgaaagctgtgaactagaagggataactcaggaaagacttataaatatgatggtaggaagagatttgacagagctatttcctaaggagatttttgaacctaaagaatacgttttagaagtagaaaatattagtgataatgttggcagagttaagaatgttagtttgaaagcaagaaaaggtgaaattttaggactagctggtttggttggatcaggtagaacagaacttatgaggcttgtatttggcgctgataaaataagtgaaggtaagataagaatcaatgggaaggaagttaagattaattcacctatggatgcaatcaataatggtatctgccttttaacagaagataggaagagccaaggattatctctagtaatgagtgtgcttgataatataactttaactaacttaaaagattttgtgttaaatcataaaaagttaagggaaactggagaaagatttaaggatgcacttgagattaaaacagcaaatcttgatgttatggcaggaacattatcaggtggaaatcaacaaaaattaatactagctaagtggttaaatacggactcggaaatatttatttttgatgagccaactaaaggaatagacgttggtactaaagctgaaatatatcacataatgaatgatctagttagaaagggcaaagtagttataatggtgtcttctgaattacctgaattattaggtatgtcagatagaatatatgttatgtgtgaaggaaaactcactggagaacttagcagagaagaagcgacacaagaaaagattatgaaattagctacgcttggagggattaataaagatgaatcaaacaattaataataaaattgtacaagaagaaggtattaagatgaaaaaggaagggtttaatattaaaaacttatttctcaaatattcaatctatctagtacttgtagtgcttattttagtattctcaatagcaagcccggactttttgggagcagcaaatgcttcaaatttcttaagacagattcctacagtgggaattttaactgttgctattactatggtaataataactggaggtgttgatctttccattggtgcaatagctgcattttctggatgtacagtagcctatctatctgtaaaaggggttagcgtaccagtttctttacttgctgggttattagtaggtgcagtttggggattatttaatggagtattaattacaaaatttaaattagaatcttttatacttactatgggtacaagttatttaataagaggattaatactattttttacaaatgggatttatatcaagggtgttccggattggttctataatatttctaacacagaagttggaatatcaataatacacactaacactatagtattcatcataatagtattagtaatggcttacttaatgaaaaatacaagatttggtagatactgctatgtggttggatcaaacaaggaagcaggaagattatcaggaataaatgtaaacaagcatgttataaaggtatatgcaatagaaggtgttttagctgcaatagctggtatattactaatgtctagtataaatgttggtgctccaagtgaaataaatggtccagatctatttgcaatggctggtgcaatcatgggtggagtacaattcggtggaggagtaggaactatcggtggagctatggtaggaatatttactatacaagtattccaaagtggattagcaatccttggaattaactcattcttacaacaagctgtaacaggagctgttattgtacttgctatagttgttgacttctacagaaaaggaagtttatttaagaaaaaaggctaatcataaaaagtcgtttgagcgtaatttggtagacttgaggcttaagtgtttactactgaataaggcttaaaatataaaaacatatctaaaaaattggaattacggaaggggaaaaattatgaagaagaaaataattgctttattatcaacagtgcttattgttggtagcttagcagggtgtggaacaaagacacaagcagggggaacagcaagtacaagtggaaaaaaggttatttattttattccaatagttgatacaggagcttactggtcacctatgaagaaagcagccgaggatgaggctaaggcattaggatatgatttagtagttaaaacttcaccaccaaatgaaacacaaaagaacgaaaagcatataggattccttgacgaagctataaagaataaagcagcaggaatagctattgctccaatggatccagatatgtttgataagaaggttaaggaagcaaatgataagggaattccagtagtaacttttgatgctgatgtaaagacaaaagaaaatagaacatcttatataggaacagacaataagctagcaggagaacaacttggtgaaaatggtgctaaagctttaaaggaaaagggcatcacaaaaggtaaaattgcaatggcagcagtaaacttaactcaaacaactatgacatatagacaagatggaataaaatctggatttgaaaaagttatgggagcagatgctaagaattttgagtggttagaaccaatccaagataatgaccaatcagcagaatctaaaagacaattagaaggacaaataacttcaaattctgatatggtagctgtattctcattaggatcagaaggaccagatacaggtgtaatggaagcaataaaatctcaaggtaaatcaggaagtatctatcactttggttttgactatactccaacttgggaaaatggtgtaagtagcaatttaatatcaggaattgttgaccaagactcttatgcaataggtaaaactataattgatactttagataagaaaataaaaggtgaaaaagttgatgatgtttatccagtaccagttaaatgggtaactccagataaaattgttgaatacggaaaagaaaaacaaaagcaatttacaacagaaactaaataataattaaatacaaataaaattaataagggctaactcaaatgattaatgtattcaaatttactttagtatattttcaaattgagttgccctttttattgctatttaattaaataacgatacatattaattggtaatagggaatgatttataagtgatttaagatacatatgaaaatcaagctttgaactaaaggttacaaggaggtttagaggatgaattttgggaataattttagtgtaggcaaaagattggtaatttcatacacgctattattcataattataacatcggtaggagtcataggtttaaagagtttaagtaaagttaataatgcatcagatagtatgtacaatacagatcttgtatctatagatgttttacatagattaaacgcaaattcattggaaataaataataacatattaagcctaatttatgatagagatgaattaatgataaaaaaattaaatgatgacatttcaaaaggatttgaacaaggaaatatacttatagatgaatatagagggttaaatttagatgaatatcaagagaatgagctcgtaaattataatgaaatttataaggattataaggaaaaaagtgatttgttactaaagcttgtaaaggaaaataattatgatgaagctatactagattatcgaaatttatcagtatcgcgaagcaaggttgcagcatcactaactaaattattagagtatagctcgattaaggcaaagaatgagaatattaacaatgctgatttatacagtaaggtagcgatacaaatattaacttttataatagcagggttgatgcttactatagttttaggatatgcaatgactagaaatatgatagtacctttaaagaagataaagaattatgcgaataatcttgcgcagtataatttttcagaggaaattatacttaagggaaaagatgaatttgcacaaacaggagacgctcttaatatagcattgaaaaatgtaagggaacttattaggacaatcctagataactcaacagaactatcagcatcatctgaggaattagctgcatctgttcatgaaataagctcaaagctttcttttataaatgaatcgacagatgaaatagcagtaggagctgagcagacgagttcatcaaccgagaaatttgttttatctattcaaaagattaatgaaaatataaataatctagctggaatagtaaatcaagagcttaaaaaatcagtagatataaaaactaaatcaagtagcatgatggaaaaaagcgaagattccatacaattatctagaaagatatatgaggagaaaaataaaaaaattaaagatgctatagagaggggaaaggtagttaaagaaatagaagttttaagtgaatctatagtaagcattgcttcagagactaaccttttagccttaaatgcaagaatagaggcagcaagagcgggagaaatgggaaaaggtttctcagttgttgcagatgaagttggaaagctagcagaagaatctattactactgtaagtggcattcatggaattatagaagaaataaaaaatgtatttgaatatttatcagaaaattcaaaaggaattttaaagtatatagaacaaaacgtaagcgatgattatgagtttatgatagaatctagtaaaagttatgaaaatgatgctagatttataaatgaaatgtctgaggaaattgctatcatggtaaaggcaataaattcaaatattgataatgtagatagtacaatgagagagttttcaagtaatatagagaaatctaaaaataattctaataaaatattagatagtataaatgaagtaaccaaagaagtagagcaaatttcctttaatacgcagaatcaaagtgaattaacagtaaaattgaatgaggtcattaatagatttactatatagatgagttgtgttaaaagagagttttggttttattaaaatataaagtatatttatattttaagaggaatttgaagacttgcagtaaaagcataatacagatatagttaaagaaggaaaatttaaatgattgatcatcatcgacctaattatcagtttttttggggagggataattattaaaaaagtaattttatttcctataattttaatatttttagttagtttaaatggctgttctttagataaaaaaaatgacacagaaaataaagaaaaaataacattaacaatgtggcatatatggtcacaaactacaatggatgctaatggaaggataattcaggatacggtggaagaatggaataaggctaatcctaatgtccaaattaaagttgaggctgtagaaaatgaaagatataaagcaaaaataaagacagcatttgctgtaaacgagttacctgatatattttattcttggggaggtggctttagtaagccattcatagaatctggaaaggtattaaatcttaatgaatatatagatgaagatacaaaagataagattaataaagatatgcttaataatgtaacctataataacaacatatatggattaccaatgactttatcagttggaacattttattgtaatacaaagctcttttcacaagcaaatattaaagtaccagaaaattatgatgaattcctagatgcagtaaaagcttttaggaataaaggtataacacctcttttagtaggcgaaaaagacaattggacaggaattctctattatgatatcttagctttacgggaaggtggaataggtggagtcagtgatccgcatgtaggtgctaataaaagtgatacaatattaaaagctgcatatagattaaaggaattagtagattcaaaagcttttaatgaatcaaatatggagcttacaagagatgaatctgagatcttatttaaacaaggaaaaattcctatgtattatacaggaaactggttcattggtgagatagggaatatggatccgtctataaaggacaatgtaatcgttaagaaattcccggtagttaaagagggagatgggaatgataaagaatttttgggtggagcagtggatcacttaatggtaagtaataatacaaaatataaaaaagaagctgttgatgcggcaaaatttatagctgaaagaatatcaaaaagatattttgaatttggttcagggcttccagcgtggaaatacactgatgataagagcaatgtaaatagattatctaaggaattagagacattaacagagaatgcatcatatagcttatacggagatatttacttaggagaagaaaagggaaacaaagagaaggagctagttagtaagctatttaaaggacaaataagtcctgaagacttcacaaaggaaatggtgaaaatagaatgatgaggatatgattaaatgtataataaattttttatattaaagaatttgaaggataaatatttaaattcaaaaataagtataaagattattgtatatttttcaataatttttgtgctttcaacagtcatacttacctttgcatataagaaaataaattctatttataatatagaaaaaatgaaacaaagttcagttgaggttttggaaagtgcagaaactaatacgagcatgataattgataatgttaataacgtatcaaagatgattatatcaagtgacaatgttcaaaatacattaaagagagttcaggaagaagggattgcctatgataatgttagtaattatctaatacaattcactaattttagctctaatatatcttcaatatatgtattagataactatggcaataagtattattctgaaaatgtcttttataaggattttcagatggataagattaaaaattctgaatggtataatgaattactagagggtaagggtaaatatatactaagattaaatggcggaggattttttgagggttatggtaataattatgtatccctcataagagaaataaatgatataaatactggtgaaaaaattggtttgataattataaacatgaacgagaatgcattctataatttaagtttgaagctaaataatcaatatggaacaaaattgattataaagaatgataaagatgaattgataacaggttcagaggttgactctaaaatactaagtaaaataaaaaattataatgattctaaatcaaaagtgttttttttagaggaaaaaatacaagataaagattatataatatcaaatcttaaaaattcagactataactggaatctgacgactgtggcagaatacaatgaatctccggagcaaacaaagtatactaattattttcttttgtgttttagtataataaatttcctattaattattattgggtctatagtaatatctaaatttataacaatgcctttaaagaagcttagtgaatcaatgaaggggattcaaagtggagagtttaatattgttaatataaaaacgtacaacgacgaagtaggagaattaaaaaagggatataacattgcaatttctcaaattaatttacttttggataaaatacgtaaagatgaaaagataaaaaggcaaaatgaattgaatttgttaatgtcacaaataaagcctcactttctatacaatacgtttgatactattaattctttagcgctactcggaaaaaataaaacaatatatgaaatgataaaagccttgggtaaattctatagaacaagcttaaataatggaaaagatattattactgtaaaagaagaaataaatacggtaaaaagctatctgataattcaaaatataagatatgaggatatgtttgaggttgaatatgatttagatccacgatgcgacgattttaagataataaaattagtattacaaccgctagttgaaaatgctatttatcatggaattagaagcagcaagaataaaggaaagataagaatatctacctttcaagaggaagaaaaagttatattaatgctagaagataatgggaatggcatggaggaatcacaagttagaaatataaacgaaaataaaactactggcattggagtaagaactacaaaggaaagattaagagtgttctatggagacgagcacgaatttattgttgaaagcaaaaaaaatgttggtaccagaataactattaagatgcctagaattaagaaatagattaagttttctaacgaatattctaaagggaagtggattattttatggataacattataaaagttatgataattgatgatgaacatcttataagggatctaataaaaaattgcattgattggaatgaaattggaatggagatagtggctgaagcttctaatgcggttgagggattgaatctaataaataaagaaaagccagatattattttaacagatataaatatgcctgtaacagatggattggatatgagtaaaagcatattagaaaggtatccagatataaaagttattgtaattacaggttacaatgaatttgaatatgctaaaagaagtataaagattggtgtgaatgattttattcttaagcctatagatgaagatgaattaagaaattcagttttaaagctaaaagacgagattcaagatgaatatctaaagaaaaaagaatacaaggatattaaagaaaagatggttgtatataataatataataaatctaaatgatgctaatgaaactgaggataaaaatttaagtatagaacaaattaaaaaatttatagtgaaaaatatatctaatcgagatttatctttaaaactggtagctgaatatttttatgttaatccaagttacctaagcagaatttttaaggaaaaaactgatgagactttttcagaatatattgtaaatactaaagtaaagatagttactgaaatgctcaagaacccaaatgcgaaggcttatgaaatttcaaaaaaaattggtatcgatgatcctaactattttagtaattggtttaagaaatgtactggtctatcaattaaagaatataaaaaacaaaagtcatgaatttacaagagtatagggatatgaagtagaaatgtaggaatatgtagtttgtaaaaactggatattattacatttctttttttggtatatttaagtttcaatagcctgaaattaacacatagataataaagaatagaagtagaaagttataattttcacgataatgttcatgttcattaattaatgaatataaaataattcacaagaataaaaaatttaaagtcacagataataaaataagttatgaatgattagtctatgtttgatgcagttacgcatttaaacaataaagcaagaaaaaggagaataaaaatgtttaaggaattcaaagaatttgctatgaaaggaaacatggttagtctagcgataggtgttgttattggtggagcttttagcaaaattgttacatctttagttaatgatattataatgccactagttggcttattgatgggaagagttgatttctctaatttattttttactttaggaagtggaaattttaaaactgttcaagaagctaaagatgcaggagtggctacagttaactatggaatatttataaataacataatagattttctgattgtagcattctcaatttttattattatacagcaaataagcaaacttactaagaaaaagggagaaaatattgttcctgataagaaaaaatgtaaatactgctacaccgaaattaattcgcaggcaacaagatgtcctaattgtacgtcagaattgaaagaaaattagataaatgagatggtgtataaatacagaaaaatgaaagaaaaatttttttatatttcatatttgtgaaaaaaaatagcttgcaggcatagtgagaattatgtaaagattcatagaaaagataaataatatgtatcatttaacgtcaaatatgttataatcaatatattaattttttaatgaacaaaatttgtattatgacaacttatgagttataaaaattgcataattggtttctaacaactaacacatgcattaaaagataattcatatgaaataaaaataataagcattgaaggagttgtattttaattggggaaaaaatttaaaagagtactggttgcaaacagaggcgaaatagcaataagaattttcagagcttgtcatgaacttggaataagaactgtggctatatacacagaagaagataagtttgctctttttagaactaaggctcatgaagcatatcaaattggaaagaataaggggccagttgaagcttatttaaacattgacgaaataataaatcttgcattaaaaaaacatgtagacgctatccatccaggatatggatttttatctgaaaatccagactttgctagaagatgtgaagaagctggtatagaattcataggtccaaaatcagaaatgatggaaaaattgggggataaaattaaatcaaaaatagtagctaaagaagttggcgttccagtaataccaggggtagaaaaacctatatcttctgaagaagaagcaattgaaattgcaaaaatatgtggttttcctgtaatgataaaagctgctgccggtggtggtggtagaggaatgagaatagtaagaagcgaaaatgagcttctaccttcttttagaaatgctaagaatgaagcaaaaaaagcttttggtaatgatgatatgttcattgagaaatatatagaaggaccaaagcatattgaaatacaagtgcttggagataagcatggtaacatagtacatctttatgaaagagactgctctattcaaagaagacaccaaaaggttatcgaaattgctccagcattatcattaacacaagaaaaaagagaagaaatctgcgtagatgcacttaaaatagctaaatctgtaggttatagaagtgcaggaactctagagttcttagttgatatgcacggaaatcattactttatagaaatgaatccaagaatccaggttgaacatacaattactgaaatggtcactggaattgatatagttcaaagccagattttaatagcagaaggctatgagttaggctctgcagaagtaggtatacactctcaagacgatatacagccaagaggatatgcaatccaatgtagaataactacagaagatcctgcaaataatttttcaccagacacaggtaaaattgatgtttacagaacaggatcaggttttggtatcagacttgatggaggaaatggatatagtggcgcagtaataagcccatattatgacagtttacttgtaaagagtactgcatatgcaagaacttttgatgatgctgttagaaaatccatacgtgcaatcaaggagcttacaatttcaggggttaaaactaatgtagactttttaattaatgtgttaaataatgaaaccttcaaaaaaggtgaatgtgatactaactttatatcaaataatccacaattatttgatataaggcctagaagtgatgaagaatacagagtattaaagttcattggtgaaaagatcgtaaatgaaactaagggtactaagaaagaatatgacgtgccagatattccagctatagcatctttagaaggcttaagcggaactaagcagattttagatgcagaaggtccagaaggtgtagttaaatggataaaaaatcaaaataagctgcttcttacagacacaactatgagagatgctcagcagtctttaatggctactcgtgttagaacccaggacatgaagaatattgcaaaggcaacagcagtttttggaaatgatttattctcacttgaaatgtggggaggagctacttttgatactgcttatagattcttaaaggaatctccatggaagagacttgaatcgttaagaaagagaattccaaacgtaatgttccaaatgcttgttagaggagcaaatggtgtaggttataagaattatccagataatgttataagagaatttataaaagaatcagctgacagcggaatagatgtatttagaatttttgattctcttaactggttaaagggcatagaggtatctttagaggaagtattaaaatgcaataaggtagctgaagtagcattatgctatactggagatattttagatgaaaaaagagataaatatagcttagagtactatgtaaataaagctaaggaaattgaaaaaatgggagctcatattcttgcaataaaggatatgtcagcactacttaaaccttatgcagctaagaagcttataactgcattaaagaatgaagtttcgatccctattcatcttcatactcatgatactactggtaatggtgttgctacagtattaatggcagcagatgcaggagttgatattgttgatacaactttcaatggaatgtcaggacttacaagtcagccggctttaaactcagttgttgctgctcttcgtaatacagatagagatacaggtattaatttaagcggaattcaaaagatatctgattattgggatacagtaagaccagtatacagccagtttgaatcagacttaaaatcaggaagtgctgaaatttataaatttgaaatacctggtggacaatattcaaacttaaagccacaagttgagagctttggtcttggacatagatttaatgatgtaaaatacatgtataaagatgtaaatgatatgcttggagacataatcaaggttactccatcatcaaaaatggttggagatttagctatcttcatggttaagaatgatttaactcctgaaaatatagttgaaaaagctaagaatatggcctttccagattctgtagtttcatatttcaaaggaatgatgggtcagccagaaggcggtttccctaaggatttacaagaaattgtattaaaaggagaagaggctataactgttagaccaggtgaattattaccaccagaagactttggaaagattgaaacatacttaaaagaaaagtataagttcacaccatgcaaaaaagacgtaataagttatgcattatatccagatgtatttgaagcatatataaaatctatattagagtacggtgacgtaagccgtatgggcagtgatgtattcttccatggacttgcagagggagaaaccagtgaaattgaaatagcagaaggaaagaccatgattgtccaactggttaaaatcggagatcttgatgctgaaggaaatagaaccttagatttcgaaatcaatggaaatagaagagaaattaaaataaaagataaaactgagagaattatcagtaattcaggtaaggatgattcatctaagatggctgatcctgataataagctagaagttggagctagtatcccaggaaccataatcaaggtgcttgtaaaagaaggagacggtgtaaaagaaggagatagtttacttgtagtagaagcaatgaagatggaaacaaatattgttgcatctagtgcaggaactattgaatctgttttagtaagtgaaggacaacaagttaaaacaggtgaattattagtaaaacttaaataataagcatatataaatagccctataagatagtttatagggctatttatagtggatggaatattaattatacagaaagtgacaagctcaaaatataatataaatatgaaataagaaatagggtaatttactgatttttatcttaactagaatatgtattaatatgataaatttattatattatgtagaaatttcgttgagtattagtagaatttaaaatataatgataatatgattaacttacaaagcatattaaatttaatggttattttaagaaggagaattgtgagacagattgatattaaagttaggtaggttgattgtatttataaataaaggggtaggtggtgtaattatgaaaaatgtgaatattgttatagtggatgactcgccttttcaaattgctttattgagagatttattgacagaaagtggatttaatgttgtgggtgaagcaggttccttagaggaaactattgaggttgttacaaatatgaagccggatttagtaacaatggatatgactatgccaggaactgatggatttgaatgtacaagggaaatacataaaattgatcctaatattaaagttataattgttagttctatgatggatgatgaaatagtaagaaaagcgaaaaagaatcacgtatgtgggtacgcacaaaagccagtagatggagaagaattaacattattaataaatagagttatggcagatgaagaattgtttttagaattggaaggcctatattcatcagtgtttagagaggctctattagatgtctttaataagcttactaaaacagtgccggtgattacacatgaaagtaatgaaaatgttgagaaaattagtaagggaatttcaattgtcatgggggttataggaaagtattcaggaagaataattttcgatatgtcatttgaaactgctaatagcataggaaaagcattgcttaagagagaggtaaagaatactgaagaaatgcttaatgttatgtctgagataacaaatatggcggcaggaaatgcatgttcaatgataaataaaagaaataggatatttggattaagggttgctccgccaaccacattccatggagaatcaattagtatatcgaaagcagaattagaaactacttattctgcgaatgcaaaaactcagttcggagatttatcaattagtataggctttggaagaggtgaaggagaatggatgtcaattatataaatccaatattaaattcttttgcaagtgtattgccacagttagggttacctgatgtagagaaaaagggaataagtctaagaggtagattcatagagagtcctggagttgtcattattgttggtattataggtgacattaaaggtaatgttatttatgggttaagcttagatgatgcaaaacgaatagcatctacaatgatgatgggaatgccagttgaacaatttgatgaattggctcaaagtgcaatttcagaactaacaaatatgttaactgcaactgtagcaactaatttttcaaaagaagatattaatataaatatatctacaccaactcttgtacatggaaactttactgcaaatgcgagttcagataaagttgtatgtgtgcaaatgggtgttggagatatgaatattgaggttaatatttcaatggagaaaaacacaatttagaacatttataatttttataataaaaccatttgtgattttgaatcataagtggttttattaaaggcgaattagattatttaaggaagtgaattcatataaataagagtatagtttcaaaagttttaagaatagctttggggatttctagagatatattttatgcgatatcaattatatccattatagttttaagtgttttaaatacaactagtatatatggttatgcaatacaaagatataaattaaatgaatacactggattatcaacagaaatattaatggataactataaaagagtaatttattatgttcagaatccgtttattaaggaattaaagtttaatagtatacctatgagtgaattcggaaggatacacttttttgaggtgaagagaatatttatagcgctatatgtatttagtataatatttattggcgttataatctttaaagtattggctaataaatcaaatgatttaaaaaagaggcttatagcaaatttcaatagtggtgtaaatatgatggcagtaatattcatatttgttggtgcaatatcagcaaaggatttttccaaagcatttatttattttcataaaatattctttagaaataattactggatatttgatcctagaactgatcctataataaatgcattaccagaagaattttttatgcttgaattaatgagcataataattttgttggtagtagttactgtagttataaagttactttatattagaaacaagttaggttcgaaaagttaattataatttacttttgaaactctctggtatataataacatttataagaaaaactgattaaatatagcgaggttaatacgatatacgctatgttaaagactcttgctttggaaggcgggagtttttttattattaaggaggagattattttgcaaaagattatttatgttggaataggtggttgcattggagctgtaatgagatacctagtgaccatgcaatcagcaaaaatgataaattctaatattccattaggaacattaatagtaaacgtagtcggaggtttccttataggaatgataatggaactaagtgtttcaacagatttgatatcgcccaatttaaagctttttttaacaacaggtgttatgggtgggctaacaacattttcaacatttagctatgaaacaataaatttaattagcgacggaagatacttatttggaattgctaacattttattaaatgtatttttaagcatagggggagttgccttagctagattagtatgtagtatatcaatttagaaaagaatagttatttaaaaaaactaaaaaaagatgagattaaagcaatgagtctatgaaaagtatgttaaaatatatatgaaatttaagggggatggactatttgaagtgtaaaatatgtggtatggaaataaatgaaataaattttaattttaatgaagaagcttttattaataagaattcgatagacaatattattcattgtccattttgtggtgtaggtaaggagtatttgagtgaaagtaacgaaataattacagtacaaagtgacttgtttgatgaaaatactttgaagattttagatcatgctgttaagcttgagctctttaatggtgacttttataacacggcagctatgagagctaaaaatgataaagtcaaaaaagtatttggagcattatcaaaaatagaaatatgtcattcaagaatacaccaaagactaggtgattttataaaggctcctaatttaagtaaagttagctatgatagatatgatagtgatagtgcacttttacaattagcaaagcaaaaagaagaacatgctgttggatattatgaaaaatataaaaatcaggttaatgacagcaatttatttgaaatatttgcagctttagctggcgtagagaaagagcatatcattcttgttgaagaatagataatctttaatttgaaaagatttaaggcttatttaaataaaaaatatgagggaagaattgatataaatttaattttgttattgtattatggtatgtatggaataaatttaacataaagacagtaataatgttcttgaatttagactttttatgtgttatcattaacaagtatcaaaaatgacatttaataaattaataataattttaaaaatatatttttgataaaagcaatgattaacatggtttgacgtctgagaagagacgattttctcaataggagaaattaaggtgcaaacccttatcattccaccattgccatgctagatggggagttagcggtgccctgtaacctgcaatccgctatagcaggattgaattcctcgcttaggtattagcgatttatagtctgacttttgtaagtggtgttgatgactgggtcccacgcaatggaagcccatgaacctcgtcagatctggaaggaagcagcgataagtggttccttccatgtgccgtggatcaatctggtctgagctaactgcattagtaacgtatagaaaactaataacgaagcgaggtgcatggtttattttaatgtttaattatagcatggaaatgaaaaattaattaggttattcttcaataggattaacataggacacaataggataagaaagtgagggcatttcagcaatgaaataccctcattttcttatcctatttattatttatttaaatttactatttactttacaatatttttaagacagcctataccttcaatttcgcattcaactatatcgccagtctttaggaatttaggtggtatgaatcccatgcccacaccagctggagttcccattgcaataatagttccaacctttaaagtaattccctgagacaattcatgaattacgtcttgtattgaagtaatcataagatcagtagtactattttgtcttagctctccgttaactctagagcatatccttaatactggaggattaacaaattcatttttagtgacaatacaaggccccattggagtaaaaccatctaaacttttaccaaaataccattgtttatgtcttgtttgaaggtttcttgcactcacatcatttattatagtataaccaaaaacataatcaaaagctttttctttaggtacatctttagcgtcttttccaatgatcactgctaattcagcctcataatctagactatcaactatttgtggataactagggatataatcaccatcagcagtcgcagtattaactcttttagaaaaatatactgcatatggtctatctccaccaaaggcttcgtttttatatcgagcagattcaactgcatgttccatatagttgatacctaaacaaataatatcttgattaggattaggtattggaggcattttagaaatattctctatggagatatattccttatcattattagttaatgatttttgtagaagatccatttcatgatctgttatgttttctattaaactgatcatgctatcataattaatgccaagagatttcataggataaactccttgctcattgagagctagtattcctacttgctctataccttcatgcttaaaagttacaaatttcataatacattccccaattctaaagattttttattttaaagttgtattgtagcccatttctaaaatagaatgtaattcttcgtaattatgatatagtaatatgaatttaaaactgatattaccgtatatttatgcctgtattaaatttacaaaagtataatgcaatccattcttttcatcaataaatttctctgatgtgtattcagtattataatttgaataattaattccagggaaatatgtatcgccttcaaattcttcatctacttttgttaagtataatttctttgcataagggagaaattgtttataaatttcagcacctccaattacaaagacttcatcttcacactccgaatatctttgaagtactgaattaaaatcgtgctctattgtcaccttatctgaatctacattaaaattattatctctagttagaactatatgttctctatttggtaaaattccaggcaatgattcaaaagtttttctacccataatcatttttttgcctgtagttatttttttaaatctctttaaatcctctgaaatatgccataataatttgttatctttcccgattacattatctttagcaatagcaacaattattgaaatcatttattatcccacctatcttaggcacaatcaaaaagtatattattttctttcatatgccttaaatttaattatactgatacgtccatttttatagattcatgatgcttataatcttctaattttatgtcgtcaggagtaaaatcatagaaatttgtaatttctggattgatccaaagttttggagcattatatgcatcattttttcttgtaagttgaagtttcaaaccatctacttgattttcgtatatatgagcattatttattacatgagtaaataatcctggcttaagtccagtaacttgagctaacagatgaactaatacagcatactgagatgtattaaatggaacaccaagtccccaatctccgcttcgttgaacaagcatacagttgagcttcccatctgttacatcccacattgtaagaaagcagcaaggatataaaggagcgctatctaggtatggaatctgccataaattaatcatcattcttctatcttgtgggttattttttaatgcatctattaatttatctatttgatcgaactttttcactatccaaccataagaagttccaatagttccgtcttccatcatccattcatcccatatttttacgttttgagattgaagttcttttacactgtttgattgatctttaaagatccaaagaagttctttaacggcagttttaaatgccacaaattttgttgttagtattggaaattctttttctaaattaaattgcataatttgatgaggtagtttataagtcttgactccagttctgttattatcgaagtaaccattttctaatatatcattagcaatggctaaatatttatcatcatataaactcattatagatatgcctccttatatttaaaaattatttttataataaaattattcaatatacattttaacctaaagtatttaacaagtcatccaatatattttatataaaagcatattaaaagtatatggtcttcagaaggagtgtaaattcaagaaactattagtatttatttttaaagatttttatattacatatatttattcaaatatatgtaatataaaactaattgtgtattttgcattgcacaagcaatagtgtataataatgttatatttaagagaaatggcgaggtggtatcccgtgggttatacagcactatatagagagtggagaccaaagaattttgaagacgttgttggacaggaacatataactacaacgttaaaaaatgaaattttaaacgatagaattgcacatgcttatcttttttgtggaactagaggaacaggaaaaacatcaactgcaaaagtaatggcaaaggcattaaattgtctagatttacaaaatggagaaccatgtaacgagtgtgagatgtgtagaaaaataaatgagggattagcaattgatgtaacagaacttgatgccgcttctaataatggtatagataagattagagacattatagatgatacaaaatatccgccccaggaagctaggtataaaatatatataatggatgaggttcatatgctttcagtaggagcagttaatgcgttcttaaaaactttagaagagcctcctaagagagtaatatttatattagccacaacagatccgcaaaagctacctataactattctatctagatgtcaaagatttgattttaagagaataagccaaaaagaaatatctagcagacttaaaaagataacagattctcagggaataacttatgagcaaaaaagtttggatttaatttcaagagtctgcgatggtgcaatgagagatgcattaagtatattagatcaagcgattgctatgggtgaagataaaattaactacgaagatttagttagtatattgggacttgtgacaaatgaatatttgtttgacataacttatgccattatagatagaagtattgaaaaatccatgattataattgataagcttgtttattctggtaaggatatgcaattgttcattaaagatttaatagcacattttagaaatttacttatggtaaaggttacaaataatccagaagaagttttagacatgtctcttgaaaatattcatttaattaaagaacagggaagaaagattagagtagaagaaataatgagagctattagaatacttcaggattcggaaacaaattcaaaagctagcaagcaaagtagattatatttagagcttgctattataaagatgtgtaaaattgagtatgatacttcaaatgaggttattttatcaagaataaacaagttggaggaatcattaaaaactggcaagattcgaatggttcaatcagaaaatattaatgaagaattaaaatctgcacataataatataggaactaattcaaataataatcaaagtagaaatgctattaataagggtaacataaatagtaacagtgttaatttagaagctaatccaaattcatcgttaacagtagatgatgttgggagagtatggacagaaatattagaaaagttcaaggcaaagagggcaatgattgtttatgcttcaatcgttacagcaaagccatatagcttaaaaaatggtatagctacacttgaatatgattcaatgtatgcatttaataaagataggttgcagaaggcagaatacagagaaattgtgaataccgtattttcagaagttctaaaggaaaaagtaattgtagattatgtagtaaaaaatgataatgaagtaaaagatcaagaagagttattaaaagaaacaatagaaggaataccatttgaaatatatgatgaataagaagttacttattcattaaacttgagtattaataaaagatgttttataattaatgaatgagattcaagaaagaggaggattttttatggcaaaaggtggatttccaggaggctttggtggcggaaatatgaataaccttatgaagcaagcacaaaagcttcaaaagcaaatggaagatatgcaaaaggaacttgagacaaaggaatttgaagcatcagtaggtggtggtgctgtagttgtaaaagtaactggtaaaaaagaagtatcatcaattaacataaaaccagaagttgtagatgcagatgacgttgaaatgcttgaagacctagtaatgagtgctgttaatgaagcactaagaaaagcagaagaggaaacttcaagcaaaatgggtaaactaacaggcggaatgccaggcgggttattctaagaatttcaatagttattaataagttagcatacaggagtgtagaagaaacttcagcctgtatgctttttataataggctaaaaatatagataaaggagaattataaattatgatggagttttatccagtagccatagaaaagttgatagaagaatttgccaagctaccaagtattggacaaaagacggctcaaagattaacattacatatattaaatcttccggatgatgaagttaaggaatttgcggatgcattagttaaggcaaaaggaacggttaagtattgctcggtatgtggaaactttacagataaagatccttgtgcattatgtgggaatcctaatagagataagggtacaatatgtgttgtagagcagccaaaggatattatgacaatggaaaaggttaaagaatacaatggagtatatcatgtattacatggaaatatatctccaatgcaaggaagaggtcctcaagatataagaattagagagcttgtttctagaatgaacgaagatgtaaaggaagtaatattagcaacgaatcctaatatagaaggagaggcaactgcaatgtacatatctaagatacttaaacctcttgatgttaaagttactaggattgcttcaggtatacctgttggtggtgatttagattatgcagatgaagttacattatctaaggcactagagggaagaaaagagatataaaataaaggaacctaaataaaattaggttcctaaaaagtgttacatagatgggagttagaagtttctatctgcatgagtgaaaagcttcttaagtataatatatataaatttgaaaaagtgttacagtattaaaataaattatgaaatcaaattatgtatatttttaccattgaatggataaaatggtagtaagaagttttttggagggatttacatgaataaaaaaaatattgtagagtacctgatgaacaagactaatgactcaactatgtatgctaagttattacatgatatggaaattgcaaaaatggaaataaatgtggctcgtagcatgtttaataatgttaacgatgacaaattaatagaagtagctatttattcagagaatgttgcaagaaaaagatatgattacttattatcaatagcaagagaaaaggggataagagtagaacataattatgtagtagaaaataatgtacgaattgttgaataaataaagtgggggagctaaatatggagggacaatatttaatatatggattagcagggataatattattatttttaatgataagattattaaaatggccgataaaaatacttataaatggtatcataggcgttgtaatattatatttagctaattttataattgcaaatctcggattaataggcataaatgttaatttttcgctggcgattaatccaattaccgctttgatagcaggtttttttggagttcctggtgttattgttttgattataataaggttatttctttaattgagttttagaattttcatttagagaattttgacattgcaaaatttaataattgttcaaagattgtctgtatttagaaatataaaaagttcattatgtttctaaatacagattttgttatttttaattataattatgtttgttaattaagtgattttgagttaatatttaatgtataaggattaaaattcctagagtattatttattttccaaggggggactcttttaacttattgagattagttttatattgaaattaatatagtaattttttatgtataaacaataaaagagtatattatgagttacgtataagaaataatttatgaaggggaaaagaaagtgaacaaagaatttcttaaaaagattataataacgggaatgacaactctaatggtaacaaacatgtgttatatctcagcatcagctaaatggattaatgataagaacaatggttggagttggttagatggagatattaaaattactggttggaaagaaattgatgaaaagtggtattattttaatacagatggaataatgaaaacaggatggcttagtgataatggaaaatggtacaacctatctaatagtggagagatgactataggttggaaaaaggttggtgaaaagtggtatcactttaataatgatggggtaatgagcataggatgggtaaatgacaatggcacttggtattatactaattttagtggagaaatggaaactggaacattaggcataagtggcaaagtttatactttctctgatagcggagaaatgctaaatggtaatactgagcaaatagaaagtggatcagagaatgtaaatggtgtaaaggatgacacgaattctcgtattgcatatgttgcgacaaataatgattcattaaacgttcgatcagatgcatcaatttcgtcagatataattgacaatatatacagaggtgcacaggttaaaattgttgatgatgaaaagaatggattctatcccataataataaatggaaaaaggggatgggtaagctctaaatgggtcacgtttaataaacctgaagatgatacaacaaagagtccaacctcttctaatatacctaattctagtgtagatactccatcagtagataataaaaattctaatgcgatcagtagttcgcttagtgatataaggaatacacagccaagtacagataataagtattactattctgatgataatcttttttataaagttaaactttcgccaccattttatagtggaggaaaaccgattaaaggaaattgtacatggtatgcttggggacgcgcttgggaaattacaggagtaaagccaagtgatgcaggatttataggaaatgcctatgaatggtgggacgcaaatcaaaaaagcggtaaataccagtatggttctcaacctagagtaggagctattgcagtttggaaatctaacatgcctaattctggaggcgatggacatgtagcaatagttgaaaaaatagatggtggtaaaatttatatatcagaatcaacttggaatggtgtaacttttaggtatagagaaatatatgataccaattatttatatggatatatttatctggacaaggcaaaccactaagaatttcataagctaaaggggctagggagtagtttttattagtgaaacataataaatattattgcacatgtaatataaacagaggttaatagtaagttataaaagctaattataaaaagctatcctgaaagagaggtgtagtaatgaaaaaaattaaaaagttaagtatagtagcaagtatagtagcatttatgctggttgtatctaatggatcacataatgttgcaatggcagaggaatcatcagtaacaaacaatagtcaaggagtaagattaaatgatgatttttatgatgcagtaaatagtgattggattaaaaatgctaaaattgaagatggaaaatctactgcgtctacttttgatgatgttgagaataaagtaacagaacaaatcaaagatataattaacaatttgttgattaataaggatgcgtataaagaaaatagtgatgagaagaaaataataaatatttacaataatactttaaatatagaagcaagaaatagagaagggataaaaccagtaaaggaaaatttagatgaaattaaatcaattggaacaatagatgatattactaagctctggaaggataagaggatattaaactcaacaataaagttttctgtagaaaaagatataaaagatgtgaaaacaaatatactttatataagtcctattgcgcttagtttaggggattcagatgaatatactaatccaacagagaatagcaaaaaagagcgtaagttaacggaagattattataataaaatattgatgttaagtggatatactcaacaagaatctcagaaaaaagttgatgatatgtttaaatttgaagaaatggtagctccgtatattaaaggaaaaaaggaaaaggctacaactaagaatttgattgatgaacaatataatgtatatacagtagcagaattaaataatttagctcctaatttaaatctaccagaaattatgaattatatgggaatagacaaagctaataagattattttagaagatccagaatggttgaaagcatttaataaattatataatcaagaaaatttacctctcattaaaaattatattgaaatagttaatttactatatgcatcaaattatttaagtgaggattttgaaaatgccaataaagaatacgcaagtaatatgctaggcataactggtaatgtatcaaaagaggaagaggccgttgataatgtaaattctatgatgggaatggctattggaagactttattctgaaaaatatgttcctgaaaagactaaaaaagatgtagagtccataacaaaggatattatagcagtttacaaaaagagaattgataatcttgattggatgagtagtcaaactaaaaaaaatgctattgataagctagataagttaaagataaagatagcgtatcctgacagttggaatgattattcaaagttagatattaaatcatacgaagaaggtggatcacttttccaaaatgcaatgacacttagaatatttgagcgtgataagatgtttaataaaataaacaaactagtggataaagatgaagatcagtttaaacctcaaacagtcaatgctttttatagtgcaacagaaaattcaattattataccaggcggaataattcaaggccatttttatgatgtaaatgcacctaaggaagttaatttaggcggaattggagttattattggtcatgaaattagccatgcctttgataatactggagctcaatatgattctgatggtaaccttaataattggtggaccgaagaggattataaagaattcatgcaaaaaactcaaaaggttgcaaatttttatagtcagattgaagcaatgcctggtgaaaagttagatggcaatcttactgtgggagaaaatattgcagatataggtggagtatcctgtcttttagatatactaggcgaaatgaataatgcaaattataaagcgttttttgaaagttatgcagttacttggaggcaaataacaacaaaagaatatgcaacatatgcattaatcatagatgttcactctcctaataaggctagagtaaatgcagtcctaccacaatttcaaaagttctatgacacatatggaattactgaaaaagatggtatgtatgttaagccgggggatagaatagggatttggtaaatgatatcttatatgttttaagtgaaaaagtaggtagcttttcaaaaaagctatctatttatttattaatggcttataatttgacattcattaattttgagttaataataatgtaagtataaagttaaaggagtagtgatactattatgccagcaggaaatggagtaaattgcggagattgtggagagctaaagcaaggaagatgtaatggaaaggatctgacttgtttatgttataagtgcccaagaaaattagcacaatgtatgtgtgttaaatattgtagagaaactgaatcagtattatattttgatgaagagaattaaaatataactttataattactttaaatgtactcctaaaggagtatgcttagtataaaaaataatcaaatgataatgttgaaagacgaatagtgaaagagtaaaataatgtataagtaaattgatatgtgcaaagaggcatatgtaaatatctcattaagagaattacatatgcctcttattttatattattcaatactttaggaaaggaagttttagcaaatgcgtagtttagaaacaaatgattggatggttattaacaatatagtatatcagattaattctattgagaattctactactatgcgaaaaaatttccttactcagatggctttagttttagattttgatagtgctgacttttatattgcatcagaattaaatagtcatacattggttaaaccagtattttacaattacaagcctagagcagatgaaaattacatggacaagtatgacagtatagattatagcaggggattaatgtttggtggtaaaagtaaagtatatagagaaagtgatattatttcagagaaaaagagagtagagacggaatactataaaaagtactttgaacctaacaattggcatcatacactaaatatgatattggcacacaaaaatcagtttgttggtgtagtatgtttctttagaataaaaggaaaagaagattttatatatgaggattcttttgtacttgatattattaaagaacatttagcctttaggctatatcaggatctaaataataattccatgggtggagaaaaaatatctatttcccagtgtgtagatacttatggattaaccaaaagggaagaagctgtgttatgtgaactaatgaatggattagagaacagtgagattagcaataaattatgcattacaaataatacattaaagaaacatgtacttaatatatatagaaagctaggtattaagaatagagttcagctatttaagatggttaaagaaagaggatgagaatactactttaggggtatctatatattaaaaaggataattaaaatggtgtttttggtgaattgttataaaaagattttgatagtatattattcacaagaagtagtgaaatagttgtttagatggaattttgtatataattttgcaattagggaggagagaggttatgaaagaaatagtattaattataagaccggaaaaattagaaattattaaaagtattttggatgaataccactgtggtggaatgacaatatcaaccgcaatgggatgtggaactcaaagaggctcgctagaaggtgtaaatgagattaagggtttaaaaacaaatataaatttattacccaaaattaaagtcgaggcagtagtagaggacaatataatagaagatattattttatcagtaatagacaaggtaggaactggcaatgttggagatggaaaaatttttgttagaaatatagaacaagttgttcgtattaggacaggtgaaagaggaagtaaggctttataattataaatatttagatgcaagggtgcataaaggtatgaatatctttatgcacttttttgttttagctcatgatagaagagttaggaaattataagcataaaagctatttttatttagaggagtgatttagatgataaaaggtatattaaagaaacttatattaagtataacaataggatgcatggtaacaatgagtttatctggctgtggttcaaatactcaatcaacttctaatggaagtacaggtgaaaattctggtgaaagtaaggaattaaatgttatctgctggtccgaatatctgcctgatgacgtcctaaaaggttttgaagaaaagtatggagttacagttaatatgactacattcactgatccagatgaaatgcttgcaaaagttaaatcaggaagtaaagggacatatgatatgattattggcccggctcaagatattgatatactaaaatctcaagatttgattcaaaaattagatacaagtaaaatagagaacttcaaaaatattgatgagcaatatttacatgaagcaaatgatcctaaaaatgaatacagtattccttatttgggtacaagcatattgatagcagttaatacagataaaattaaggataatataaaatcatataaagatttattgaatcctaagtataaagataccatggttgttgttgaagatgccagaccaatagtcgggattggattaatgacaaatggatataagataaatgatacaagcgatgaaggattaaagaaagcagaggactttttaacacaattgaaaccaaatattcatgcattcaacggtgatagcccaaagacattattattaaatggtgagtgttcattaggacttgtttatggaggtgaatgcgctttagcagctaaggagaatccagcaattaaagtagtttatccagaagaaggcatttatttcacatttgatatgatgatgaaagtgaacggagctaagaattctgagaatgcagacttactaatgaactatatattagatccagaagtgagtgctactatttcaaagactttcccatatgtaaatccaaacaaagcagctaaagatattctaggagacgactttaaaaataacaatattatgaatatcccagaggctgaaatgaagaaaagtcaagggttacaagatattggagaaaatgtatcaaaaataactgacttatggactaagtttaaaggataagggtgaaaaataagactttggaggggattaaatgtctgaggttatcgtgaaaatagataatataaataaaaaatacggagataatcatgtagttagagatctatttattgacataaaaaaaggtgaatttttaactatgcttggcccctcaggttgtggtaaaactacaaccttgagaatgatagcaggcttcgaaacacctactagtggaagcatttatattgagggtgaagaggttcaaaactctgaaccttatgagagagaagtaaatacagttttccaaaactatgcactatttcctcatatgactatttatgataatttagcttttggattatcagtcaagaaagttaacaaagcagaaattaaacagcgtgttacagaaattctcgagctagtgcagctagtgggatttgaaaatagaaaaccagatcaattatcaggtggacaaaaacaaagggttgcaataggaagagcccttataaatagaccaaaggttttgctgctagatgaacctttaggagctttggatttaaaattaagaaagcaaatgcaatttgaattgaagcgtctccaaaaaaagttgggaattacatttgtttatgtaactcatgatcaagaggaagcacttacaatgagtgatagaattgcaattatgtatggaggagatttagagcaaataggaacaccaaaggaaatatatgaaaagccaaaatctaaatttgtggcagattttattggagaatcaaatattttttatggagttgctaataagttagagaatgatttatcaagagtaaaattagaaaatggagatgctatagtattggattctcaggttatggataatgaaataatttatgttctagtaaggcctgaaaatataagattatctaaggaagcgatagaaggatttactcttgtaggaaaagtaaaagagcatgtctatattgggaatgttaataaaacaataattatgcttccaacaggaatggagataaagatgaatactactccaaaagtggaattactaccaataggttcagaagtatatgtgtattgggaaaaggaagatgcagttgttattaaatcacaaagccaagaagtcttcaatgttgtagataatcccgtatttacagtagagaaccaaacaaaataaggaggtgcttaaatgaaaagtaaaaagaaaataaacatgcctcttataaccacagttggtccagtttcagcatggatgattttgctagtagctattccatttatttatgtcttcgttatgagttttatgaataagggggcttatggtggagttgttattggatttacattaaataattttatacaagtatttgatccgttatatttaaaggtttttggtgaatcatttttgatttcgacctttacgactgtaatctgcatagtaattgcatatccatttacttactttatagcccaaaaaacaactataaagaagacagtttttatggctatggtaatagttcctttcttggtaagttcgttaattagactttttggatggatcaatttacttcgcaaggacggtattataaattcactattgttgaaattaggagtaattaatgaaccacttcaactagtatataatacaaccggggtaatgataggtctagtatatatgttattaccattcatgattttacctttatatagctcaattgaaaaattggataaatcgcttttggaagcctgtagtgatttaggagcaaaacctattacttcttttataaaagttaccttaccacttacgatgccgggaatatttgcaggcagtattctagtatttattccttcattaggatatttctttgttactgacttacttggaggaagtaaaactcaagtaattggtaatgttattagaactcaatttataaccgccaggaattggccactcggatcagcaatttcaatatttttaattgtaattactttggtacttgtatggttataccaaaaatcaggtggtaatatggacgacttaggaggtatgtaaaatgacaaagatgcagaaaaagaatatatctagaatatttaaaaatatttatatttatcttgttttcttatttttatatcttcctatcttttatgtaattattttttcatttaatacttcaaagttaaatattactttcgaaaatttcacttttcaatggtatgggaccttcttcaaaaatagaactttaatggaggcgctttcaaatactttgattattgggattataagtactattatttcaactattataggaactattggtgctatagggctaagtaaatacagatttagaggaagagatgtaatagataaattattatacatccctatagtaattccagaagtagtacttggtattgctctactttcaatatattcagttcttagtattcctttaggattaattagtattactttatctcacattactttcagtattccttttgttgtaataacagtgagagcaagacttgccggatttgacaaatatcttgaagaagcagctatggatttaggtgcaaataggattgtgactttctggagagtaacgttaccgctcataatgccaggagttttgtctggtgctatgctggcattttcattatctattgatgatgttgtaattagcttctttacagctggaccaggaagtacaacacttccacttaaaattttctccatggtaaagactggagtaacaccagaagtaaatgctttatccacagtaataatggttataactattataattatagctttaaatactgcatttcaagttaggaagcttaaggcacaataagagaatagtagaacggtatgtttaccttttatttattttcatgttcataaagataataaggaataaaggtttactaacttgaataagagggtgagttaatgattaaatacgatgttgttattaagaatggaatcataatagatccagagcgaaaaaagagcactattgctaatattggaatcctgaatggaaaaataaaagctataacaagagaagatatggaaggtaacattgaattagatgtaagaggcaaaatagtatgtccaggtattatagatattcatgctcatgtagagggagatttagattgtgctagagtgctagcagccatgggagttactacagtatacaatggtaattgtggaatgtctccagaaaatattaaggaattctacaataagtatgatagttttttaatcaatcaaatagaacaaattggacatattactctgagagaacaagttggggttactgatagatataaatcatccagcgatgaagaaattgaaaagatgaagggtatccttgaagaagcatttgaatttggagtcagcggattatcattcggacttgaatatgttcctggaagctcaaggaaggaagtattagaactagcaaaagttgcagcccaatatggaaagttagtatcaattcatacaaggtcagactcctatggtggcctttctagcttaagagaagctattgatataactagaaaaacaggtgcagctgtaaatatatctcatctaacttaccagtttggaatgggaatggcaacagaagctcttcatatgatagaagaagctttagccgaagggctagatatatccgtagatagcggattgtatagtggatttgcgacttccattggaagtgctgtttttgatgaaggctgcatagaaaagtggggatgcgattatagcagcttaatagctgggactggtaaatataaaggtaagagattaaccaaagaaatttatgaagaacttagacgaaattatcaggatgatacggtcataggcatggtgggagaggaatatgaagtatttgaaatcctagaaaaaccttatgtaatggtctctacagatgcgggaacattatacgatgctggagttccaggtcatccccaagatgcagggacatatcctaaattttttaaaactatggtaagagagcagcatagaatcacgttaatagatgctataagacgatgcacatacatgccggcaaaacgcttaggattaataaataaaggatttattggagttggagctgatgcagatattttaatatttgatgaaaaaataatagaagataaagcagattatccatgctttggagctacagacacaaggccagaaggcattgaatatgtttttgtaaatggagttattacagtaaaagggaaagaagtattggatataagtgcagggaaaactattaaagataagtgtcttatgtggaattgggagcaatgataagtatggaataaactaataaggtctaccacaaatattcttgagaatattagaatatatattcttcggaatattaccataaatattcttaagaataagtattctgtaccatatatattcttcagaatatgcttaaaaaatcgggagctacagatattttattagaatttgaaattaattgttaatagaaattaatctgtgaaattcacagcaaaataaattgttggcaaaaataagttgagagatcttatattaattaaatgagaggaagagatattatggaaattaaaaagatgtacatcaatggtgaatgggtagaagctatttctaaaaaaacgagagatgtaataaatccagctaatggacaagtaattgcaaagacaacagaaggcgggattgaggatactaagctagcaattgcagctgcaaaagaatctttttatggaaaaggtgaatggaggagaatgaatgcacaagctcgtgctgatattcttttacaaattgcagataagatagcagaaaaaagagataaatttgcaatgctcgatacaatagataatggaaaacctcttcgtgaggcagaaggtgacatagatgacggaattcattgttttagatattatgcaggcttaatcacaaaaccatatggaggagtttatgatgtaaatgatggatttgggcaaatgcactcatacacagttcatgaaccagtaggggtatgtggacaaatcactccatggaactacccatttttaatggcagtttggaagttagcgccagctattgcggcaggaaacagtgtcgtatttaaacctagttcaaatactcctttatcaacaattgcattatttgaaatatttgatgaaatagggcttccaaagggatctgttaatttggtattaggttcaggtggaactgtagggcaggaaatagctgaaagtaatgatatagacatggttactttcacaggaagtacagaagtaggacaaagtattgcaagagctgctgtaggaaaccttaaaaaagttggcctagaacttggggggaaatcaccaaatattatttttgcggatgcggactttgaaggagcagttgaatgggccatggttggtatattctttaatcaaggtgaagtttgttcagcaggttctcgtattattatcgaggagtcaattaaggataagtttgtagcacgtcttgcagaaaaagcaaatgcaatgactataggaaatccagtaaataatccagatatgggtccgttagtttcaaaagaacatatggaaacagtattaaaatatattgagataggtaagaatgaaggtgcaaccctagtttgtggtggagaaagatacacagaaggagaatgtgcagaaggatattatgtgagaccaactatatttgacaactgtacttcagatatgacaattgtaaaagaagaaatctttggacctgttgtgacaatacaaacatttaaaacagaagaagaagctatagcattagcaaatgataccgtatatggtttggcaggagcagtatttacatcagatggaactatagcattaaaagtaattaaggaaattagagcaggtatcacgtggattaattgttataatccaactttcaacgaagcaccatggggaggatataaaatgagtggatatggtagagaactaggtgtccacggtttagaagaataccaagaaataaaacaaataaacatcaatttaaccccaggaccaattggctggtacgaacattaaatttggtataaaatacttgcagtttgtatgaaagtttaagtttacttttaaacacttcgcaaaaacatatattacctttatttgtttggtgtaaatttaaggtgacagcatatttaggcaagtatttttatctctaaataaagtatctgtatgttaaaaaatacgtaaagggaaagcaaacaaagaaatagaacacatatatgtattctatttcggttgtccattgcctctctttaagtatttagttattctctaaattttaataagctccatttagtagacacattgaatttgcggtataaattctgaatgtgtttttttagtgtatatccacttatataaagtttgttagcaatttcatcattattcatatcctgaaaaattaattgtaaaacttctacttcacgattcgttaaattatacttcgaggctagatttgccatagagaacgatatattggaagaattttttgaatcctttgtataatattcataaaagcgaagattgagatgatcgctaaaggcctttacaatgaacatctcatcggaggtaaaatctccttcttctcgtttacgataaattgtgagaactcctaaaaataaatcattatatacgagatttaattgtaatgagtaatgaagcctaaatggctcgtagcatttcttatatagtactgttttcactctctcttcttcaggcattaaatcgctttcacgaataagtaggcattgtccgctcaacattacccaacgagtataatcttcatcttcatttaaaaggtaatttttttcagtatctgagtaaacctcagggacacagatgggatcacataccaagttcttcgaattagtatggtaagccattaaaatactggaggctgtattaggaattaacatttttagtaggttcaaaaatgttattttcattgtgtcaaaatccggaatgctatatatctgataaattatattatttattaatagaaattcattattttgcatatagataccttccataactatatattactaatatttatatctgcataaatattctataaatatgcgagattattaaaggtattttaccataaattacataaattgtacatgcggttatgatacttaaatattattgtaagtatatgctaataaggaaagaagatacttataaagtagtatacgtacttctaaaataatgcaataaccatacattgagagaattgttttaactagggcatttgatttataataatatcaatagagaaaatagattaaatacaacgacgtattactgatttaaaatcattgtaatgcgtcgttttaattttagaaagggagtaattattatggcacaaaaagaacaaattattgaagatttaaacagagttataggatatataaaaagcgatggattaacaaacgaggaaaaagaatcaattacaaaggatacaataaattattttgataactatgtaagtccaggatggcttaaatacagaaaatcagtatcaacaaatgcagcagttgtagaatggacagatcagggagcatattgcacaggattatatggagaagaatttatagattgtctaggtggatttggaatttatacatgtgggcatagaaatgaggaaatacttgatgttgtaaaagcacagctcgatcatcaagcattacattcacaagaattattagatccattaagaggatatcttgcaaaagcagttgctgaaattacgccgggagatttagaatattgctttttcactaatggaggagcagaagcagtagaaatggcattaaagcttgcaagaatcgcaacaggtggaagatggtacatttcaacagtaggagcgtttcatggtaaatcaatgggggctatttcaatggggggaagagcacatacagagtgccgtatacaccaatggtacagcaagttcaacacgttgaatatggaaatgcagaagatataaggaaagctataagtaatctatatgcagtaggcgagaaagttgcagctgttatattagagccaatacaaggtgaagcagggattatcattccaccagaaggttatttacaagaagttcgtgaaatatgcgatgaatatggagttgctctaatatttgatgaaattcaaactggaatgggtaggactggaacaatgtggaggtgtgaagcagaaggtgtaactcctgatatcatgacttttggtaaggcgtttggtggaggaataatgccaataacaggtattatatgcagacctaaaatgtggacagaagaattagtggacaatccatggcttttaggatcaccaacttttggaggaaatccagtttgctgttcagcagcgcttgctacaataaaatatatgctagaaaatgatgttccaggacaatgtaaagaaaaaggcgaatatttaaagtcagggttagaaatgttatggaagaagtatcctacagttataaatgaggtaagaggtactggacttatgttagctgtagagtttcgtgaaagtgatataggatactctgttgctaaggggttatttaaaagaggcgttatgactgcaggaactttagtaaatgctaaatgcatccgttttgaaccagcagctgttatttcaaaaaaagatatggataatgttattgagagaatggatgcagcattggaagatacaaaaaaggaatttaatatttagaagtaaagatgctatatatcaatgtatatagcatttttttcacgataaggagatatgtgcttatgagacaattaatgctaggtcctgtgatatataaatataatgattgtaaaactttttgtaaggaatttcacataggcaaagatgatctgataattacaggaaaagaaatatataataattgcttgaaatttaatgtaaatgaggcagcagttctgtttaaagagaactatggaattggaaatatgtctgaggatatcgttgagagtatgtatgaacatgttagaagaatatctcatgaaaggattattgctattggcgagaaatgtattttagagatcggaaaaatattttccttaacaaatatttctccagttgtagatttatacaataataagatagaaataattaaagaaaaagaattagtattagtcccaactaaacttggtatcggaagtgaagtaaataatgtttctgaattacaattaaaagaaaataatatgaaagtaagccttgttgcagatgaattatatgctgatagtacagttatgataacagaattactaagcaaattaccactagacctgcttataagtagctctataaatgcattaattcatgccattgaatcatatttatctcccagagcaactgaatatactaggcttttttctttaaaagctgttgaaataatatttagaagctataaaaatattataaacaaggaaatggttatgagtagtcagatattagatgattttcttttagcaggcaattattcagaaattgcttttgcaaatacaggtgggaaggatttagatgtaattaagcaggcattaagaaaaaaagataatacagttatgtatggagaagctaattatattacgtttgtggaaatgattaaattttatcagggtatatatcctgatagtgagattagaacattgagtggactttttgcaaatttgttagagtgcgacactagcgaagtgtttgaacaagtagagaatctattatgcaatctaattgtaaaaagttcatcaagtaagaggagatagattaaatatagaagaaacaaataaatactattttacatcagattatgatatcaaaaaaagtatggagtttaataagaatgatctatatttttttgatataaaagaaattgtaattggaataataagttatagctttgtactggaaagaatataatattgatcattagaaactagttaaaatcacgaatatttagatttataatgcatatatttagttcatcataatggtaatattttatgaaatttatatagaattgatattatctatttcaaatataatgttgacatttttagagaataagattattattatagtattaaattgagaataaattaaattttatggagtaaaaattaaatattgataaatagataacaacggagttattagacattttagttttgtttaatgactccattgccataatatattgaaatttttaagcgaatgtggaagcgcttccaagaaaacagaaaatatttaaaattttattaaaaactttaaatattcatacagaatttccaaatattaaaaaataaattatataaaataaaaaaagaaggagagaaatacatgttaaaatatattggaaaaagatttcttataagccttgtaacgatatgggctataatcacaatagtattttttctaatgagacttatgccagggggaccatttgatggtgaaaagttaacaccacaaattaaggcaaatatggaagctaaatatggaatggacaagccagtattagagcaatatgggatgtacatgaagaatttagttcaaggagattttggcgaatcaatgacttttaagggaagaggcgttacagatactatagctaaatcttttccagcatctgcaaaaattggaggcgtagcagtaggaatggccgtgataacaggtataattcttggagtgcttgcagctcttaaaaatggaaaatggccggataaattaatagtgttcatttctacattatgcataactataccaagttttgtaataggtgcggttttaatatatgtactagcagttcagttagggttattaccagcgactggatttggagaatgggagaattatgtaatgccatgtatggcactagcagcagcaccattatcatttatcacaagacttacaagaagtaaattaatagatgtattgaaagctgattatataagaactgcgaaagcaaaaggcttaagcaaaactacaattatattcaaacatgcattgagaaattctttgataccaatagttacatatattggaccattaatagcaagcatattaacaggaagttttgtaacagaaaagatttttgcgattccagggcttggaaatgaattcgtacagtcagttacaaatagagattacagtatgctgcttggagtaactatattctatggaacaatgttagtattttttgctttctttgtagatgtaatatacgtattaattgatccaagaataaaactacaagatgcagaagtttagggaggaagagaagatggaaaatggattaaaagttaaaaaggatttatttactcctctaagcgaagaagaaaagaaaattgaggtatcagtaagaccaagtattagttattggaaagatgcttggatgagattgaaaaaagataagtttgctataatatcacttgttgtaatagtagctgtaatccttggagctatatttgttccatggttatctaaatacaattatgcagcaaatgatttatcatcaacatatttgaaaccttcggcagagcattggtttggaacagacaatcttggaagagatttgttcgttagaaacttttatggagcaagatattcacttcttattgcggttttagcggcagttattaatttagtaataggagtattttatggtggaatagctggtttctttggtggaaaagtagatgctatattaatgagaatagttgatatcatatatgcaattccgttaactatatatgtaataatatttatggctattttaaacaagccaggttcaggcggaagtgggcttcttacaatagtaatagcactttctatatcgtattggattggaatggctagaatagttagaggagatatacttcaattaaagcaacaagaatttgttcttgcagcaaaatcattaggtgcatcaaatgcaagaatattaataaggcatttaatacctaactgtatagggtcaataatggttacattaacactattaattcctgaagcagtatttactgaagcatttttgagttttatcggccttggaatagctgctccaagagcatctcttggaactttagcaaatgaagcaatggttggtatttatacatatccatatcaattaatatttccagcggcgatgatttgtataattatattagcgtttaacctttttggtgatggattgagccaagcattagatcctaaaaacaagagataggaggaagaaagagtatatggaaagattattggatgtaaaagacctacaaacttcctttaaaactagtgctggtgaagtacactcagtaagaggagtatccttctacttagaaaaaggagaggcattgggaatagttggggaatcaggttgcggtaaaagtgttactatgatgtctattatgagactcctagctgacaatggaaaaattgttggtggagaaatacattttaatggaaaagatatctctaatattagagaatctgaaatggaaactataagaggtaatgatataggaatgatttttcaggatcctatgacatcattaaatccagtatatacaataggtgaacaattaatggagcctcttttaaaacatagaaaaattagtagagcagaagcaaaaaaagaagctataaagatgcttggattggtcggaattccaagtcctgaaaaaagaatgaagcaatatcctcatgaattttcaggtggtatgaggcagagagcaatgattgctatgagtctaatttgtgagccaaagcttattattgcagatgaaccaacaacagcattagatgttactattcaagcacaaattttagatttaatgaaggatttaagagaaaagcttaatactgcaattatattaataactcatgacttgggagttgttgcagatgtttgttcaaggataaatgtaatgtacggtggaataatagtagagactggaacaacagaagatatattctacagagggaaacatccttatacatggggacttttaagaagcgttccaaatcctaaagaagatataaaggaaaagcttattccaattgaagggcaaccaccagatttattaaatccaccagttggatgtccgtttgcagctagatgtgactatgcaatgaagatatgtattcaaaagcagcctccattatttgaagtaggagaaaaacatcaagcagcatgttggttatgtcatgaggatgcaccggaagttgaatcacctataaggaggataaagtagtggaagctaataaagatataattttagaagttaaagacttatgtaaatacttccctgcaaaaaagggcttatttaaaggcaatagctatgttaaagctgtagatagagtttcatttacaattaaaaagggagagactttaggacttgtaggtgaatctggttgtggtaagacaactacaggaagaacaatactgaagctttatgagccaacatcaggacaaataatatttaatggaaaagatataacaaagaattcagtaaaagagatggttccgttaagaaaagaaatgcagatgatatttcaagatccatatgcatctttaaatccaagaatgactgttggggacataattggagaagctatagatattcataaattgctaacaggtgaagcaagaacagaaagaataagaagtttattatcaaaagttgggcttgctagtgatcatataaatagatatccacatgaattttcaggtgggcaaagacaaagaattggtattgcaagggcattagctgttgaaccatcactaatagtttgtgatgaacctatatcagcgctggatgtttctattcaagctcaagttataaatatgcttgaagagcttcaagaggaactcgggttaacttatctattcatagcgcatgatctttcaatggttaagcatatatcaactcatattggagttatgtatcttggaagaatggttgaaaagggagaaagtaataaagtttactctgaaggattacatccatatacacaagcattgctttcagcagtaccaataccggatccagatgtggctaagaatagcaaaagaatagtacttgaaggagatattccatcgccaatagatccaccgccaggatgtagatttaaaggtagatgtaaatatgcaaagccaatttgctcagaagttgatccagagttaaaggaagtaaaaccaggtcatttcgtggcatgccacttgtatgataactaatgtttatcaagaaaagtaattagttaaagttcaataatgattaagaaataaaaaaataattagatatttagcatactgttaaagaattttgggaaaaatgatttaaacagatataaataataaataataaattaagggggaatataaatgaaaacaagcaaagtaaaacaactttgtgcagtagctttagcagcaacacttggaatgtcaatcttagttggttgtggttcaaataaaggtggagataaagcagctgcaagtaaacaagaaataacttataatttaggagcagatccaagaactttagatccagcattgtgtacggacactactggaactactgtaatagcaaatgctttttcaggtttagctgaattggatgagaatgaaaaggcgattccaggtcaagctgaatgggaagtatctaatgataaactaacatatacttttcacttaaaaaaggatcttaaatggtcaaatggagatccagttaaagcaagtgattatgaatatgagtggaagagattattaaatcctgaaactgcttcagaatacgcttatgcattatactatcttaaaggtggagaagcttataacaaaggaaaaggaagtgcggatgctgttggggtaaaggcaactgatgataatacactagttgttactttagaagctccatgtccatatttcttagagttaacagcacaatcatactacttcccagtagatcaaaaggttgttgaaagtaataaagattgggcaaatgatgcaaaaacattagtttctaatggtccattcaaaatcacaaattatacaataaaagactcagtagttttagaaaagaacgaaaattactatgataaagataaagttaaacttgataagttaaacttaaaatttgttgcagaagaaacatcagcatgggcaagttataaatcaggtcaatttgatgtagttgatacagttccaaaatctgatgtacaaggtgctttaaaagatggaagtgctaagtcattccctaatttagcaacatatttcttatcaataaatgtttcagataaggcaaaagctgtagatccaaatgctgctaaggttttaagtgatccaaaggtaagaaaggctttaaatcttgcaattgatagacaatcaattgttgataatgttactaaggctggccaaattcctgctcatggtattgtaggaaaaggaattataggtccagatggaaaagactatacagaaaaaactacttattttgatccaaagggaaatgtagaagaagctaaaaaattattagctgaagctggatatccagatggtcaaggattaccaacacttcaactactttataacccagagtccggtcacggtgatacaatgcaagcaattcaagatatgtggaaaaagataggcgtgaatgctgaacttcaaagccaagaatggaaagtattcttaacaacaagagttcaaaagcaatttgagcttgcaagagatggttggaatgctgattatgtcgatcctatgactttcttagatatgttccaatcaacatcagatcaaaataattgcggatataacaatccatcatatgatgctttaattgatgctgcaaagaaagaattagatccacaaaagagatttgatataatgcatcaagcagaagatatgttaatgaatgatatgccagttattcctttatactattacactaggacaataggtataaaagattatgttaaaggcgctagagtatctgtaatgaacactatctactttaaaaatgcttatgtagaaggcaaaaaataataaactttagttaaataaattgaaagaactactttaaaatatgcttatattttagagtagctcttttattttttagggaaatataatttatattctggtgcaagcgagtttttacgtttccagctgaattaagtataagtactcgattactaggattttgaaaatatatactttaagatttatattaagcaatttttaagaaatatttacatagatttaacagtataaaagcatcaatattaaaatcataatttggcccataaagtattgaattaaagccaaataagtagtaaaataaaaaagataggatttaagaagtgaaataaatattccaagtccaaggataaaatttaaagtttattatagagtaatttatatggtgcagaagcttagaattatatagaaatataaggaatttaagtctatgcaatttttttagctctacaattcagataagtttaataggatatggatattggatattgtttatggcactttagtagtggaattataattaattgtgtgaatttatgttagctattatgaaaaggcggataatttatctgactaataatattagtagttaataactatgatataacaattagttattgtttgaagcttataaattttattagaaatattagcaataagcgtatttaaattaagggggattttaaacatgatcaaagtattaacaaacgacggattagaaaatgcgtcaattgaggcattgaatggattgggagtagaagttgtcaatgaacactttaaccaagatatattgggggcgaaattaaaggaatttgatgcagttgttattagatcagctactaagcttacagctgatgtatttgaagcagaagcaggcggaaatttaaaattggctattagagctggtgttggaatagataacatagatattcctgctgcacaaggaaaaggagtaacagtaagaaatactccatcagcaagctcagattcagttgcagaacttgcaattggtcatatgtttgcacttgcaagatttattgcgatatctaactacactatgagaaatggtgaatggaataaaaagaaatatgaaggaactgaaattgcgggtaaaacacttggaatcgttggaatgggaagaataggtcaatctttagctaaaaaggcaactgctttgggtatgaaggttgtatattatacaattgaaggaaaacatgatgatttagattatgattttgtatctttagaagaagtattaaaggtttcagattttatttcacttcatgtaccttatgataaagcggctggttcactaataggaaaaaaagaattggaattaatgaagaatacagcatatcttattaattgtgctagaggtaaggttgttgatgaagcagcattaatagaagcacttaataaaggtgaaattgctggagctggtattgatgtatttgaagaggagccaactaagaatgaagaattaattaaccatccaaaagttagtgccaccccacacattggagctgcaactaaagaagctcaaacaagaataggtgaagaagtagtttcagtaataaaggaattctttaatctataatttaggaggaatttttgatggcgatagttaaagcttttagaggaattagaccagttaaggaattagcttcaaaaatagcagctttaccatatgatgtaatgagtagtgatgaagcaagagaaatggtggttggaaatcaacactcatttctccatgttgatagaccagaaatagatttagatccagaaatagatgtacatgatcctaaagtatatgcaaaggctaaagaaaatcttgatagaatgataagagatggtgagtttgttcaagatgaagaaccttgtttatacatatataggcaaataatgaatggaagatctcaaacaggaattgtattctgtgcatctatagatgattatatgaataatataattaaaaaacacgagtttacaagggcggataaggaacaggatagaattaatcatgttgattattgtgatgcaaatactgggccaattttcttaacatacaaggaagatcaaattgcatcagaaataatagatgcttggattcagaatgaaagtaaaagaaaacctatatataatttcgtagccgaagatggtataacgcacattgtatgggttgtagataatgaaattattatagacgaaatagttgacctatttaaggaaatagattatttatatattgcagatggtcatcatagatcggcttctgctgtaaaggttgggcttaaaagaagagctgaaaatccaaattatactggtgaggaagagtttaactatttcttagcggttgcattccctgataatgatctaatggttatggattataacagagttgttaaagatttaaatggaatgactaaagaagaattgattacgaagttagaggaaaactttattgtaactaaatctgaaaataatgtgcctgtaaagcctgctaagaagcatacatttgggatggatgttgaaggagaatggtatttattagaggcaaaagatgggacgtttgatgaaaataatcctatagcgcaacttgatgttgcaattcttcaaagtaatgtactaacaccaatcttaggaattgaagatgtcagaacatcagatagaattgactttataggcggtatcagaggaatcaaagagcttgaaaaaagagttaattcagatatgaagattgctttttctatgtatccaacagaggttcatgacattatggatgttgctgatattggagaggtaatgccaccaaaatcaacatggtttgagcctaaattaagaagtggattatttattcatgaattaaaatagttgtccccgtcaaaaaaagattaactaagaaataaaaaagattgactaagtggcggatcagtaaaaaagagaactcaaaatagaataaaagatagagcataaaagcgagtagaacacagccttcgggtcggttttcttaattcgaatttatgctctttttttgcttaaaaatagagttgtgttcagtttctatttaatgaaaaataaatatattttaatatttttctataaacatatgtataaagataaatatatttataggaatatatttaaaaaggaatctacgtttatagaaaactatttaaaaatgtaaatatttaaatagaaaaatataaacatatgtaaatatttataggaaacatcaaggtttcagcctagtatatttatataggtgtcacgttaaaacaatcttattccttttcctatgtccttttttctgtttagttttctgcaaaatttattataaaaacctgtgattaatgtgggtatattgaggctgaaaaggacaataattttggcacttatattaattttattaaaagaaaaagtgcagaatagaaaaagttatcgggattaatttgctcaaggcaagatatcttgaaatataactagaaacttagataacttaaaaaaagaaggagttttagagagagtggagaatatttaaataaaatataaaaacttacaactaggatgctggaggattaagttaatgtgcggtggagttattatcggtgatgacgaattaatatctgacattggaaatatagttgatatagataataaaaattatgagtattttaattttttaccctatgccatattggttcagagaggtggcaaaattgtttttgctaatgatgaattgcgaaaacttctacattgtagtgatgaatctgtgctaggtaaatcgatcgtatcactattgcagttaaagagtgatgcgatatttagtgactctattaatgaatcatttaaagttattgaaggtgagcataagattaaagactttcagtcaaatataattgatgtagatataaagtgtaatattaagcaattaaataattgttggtatgagttttttgtacttagagatacaactattaagaagaaaaagtacactgatgctataaagaaggcagagaaatatacagatatacttgagggacttccaattgttggtatgggtaaagagcgcgtagggattactattagagatgcgtcagaaagaggggaattgcaagagaaactgtttgagagcaaagaactatataaaaaactaattgatatcctaccagatggggtaagtattcacgatggtattacttattcctttgttagtgactcatatgctagaatgttggggtatgataatactaaggaattagtaggaaaaaggcttgacgaagtggtaagtaaagaaaatcatgaacttataaagcgacaagtagaaaacctcttatataaggataaaatgtttcaaagggctgagtataaattcattactaaacagaatatatataaagactttgaatctacatctataagattctggtataataacaagttaaatatactatcttcaattagagatatcacagataaaaaaaggattgaagaaagtaggctgttgctagagagagcaatagagtatgataaattaaaaacagaatttttctctaatatgtctcatgaactaagaacaccattaaatatacttttaagttcactacagttaataaatatgaacacagatacaaaaggaaatatcaatctttcatcaataaggaagtacacgggtataatgaagcagaattgttatagattgctaaggctgattaataatttactagatataacaaagatagattcaggtttttatacattgaatatatgcaatcatgatattgtgagaatagtagaagatattactctatctgtagcagaatatgtaaaggaaaaaggcatagagatcatttttgatacagatatagaggaaaaagtattaggatttgatgcagataaaattgaaagagtaatattaaatttattgtctaatgcggtaaagttcaccaagtctggtggaaagatagatgttagtattcaggatctagcggattatatatatattactgtaagagatacaggaagcggaataccaaagaataaactaaatagtatttttgataggtttatacaagtagataaatcactttcaagaagaagcgagggaacaggaattggtctggctcttgtgaaatcattagtagatatgcatagaggaagtattactgtagaaagtgagtatggcgagtacacgcagtttaatataatacttcctgcaaaagttctcgctgatgaagatgaatcggggatatgtaatactgaaataaacaatgatttagacgataagaaagttgaaaggatgagcattgaattttcagatatatacttatagttgaagggataaaaaaggattttaaaatatattcgttgctatattactatatagtgttatactgtagctatagatgtgaatactactcatggaggaaattgatttataaatgtgaagataatctttttctactatgttattttatttatggtagttacatataattaaaataaaaagtaaatggacatgtaatgtatctgttaaaaggtatattacagcctcgtgttgaagagccacttcgtaatcctcgaagttggctcttattttttgcaattaatagtattgtaactattaagtctatatactaaggagattgaatgaggtgcatgaagcgaataaaaatataaataatgaagaaattgaagaatatgaaatagacttttatataaggatattagaagccttgatagaaatttacgagtgtaattcaaaagaaaatgagtagttagatattttttgtagtattcatatctataaaatagatagaggcagatcttagttctgcctctatttttaatattgaatcttttattaatatcataagtttgtgaataatctaaaagaattaaataattaaagaagttaatttaaaatatggtgaaccttcagcaagaagatctatcgcctattttagtctgataggaacaacacaagtggatttaagaaatccttttgtaactgcttgttggcaagtagtatttctaggcatgagccatttgctactaccaaaatataaacttattataaaaaaactgtgattaatgtggatatatctaaagtaaaaaggaaggttttgtggataaatttatacaggccttaaataagataaaaggattcagaatttaatagatagaaaattagaattgataaaggaactgaaggatgttagcaaagtggaattccactaatgcaacaaccctttaatttaggaaagtttctcttctataatttctggttctgcagaattatctataaaaacataataggagtatatcaataaaagcaaaattataaaaatagcagaaaatctatacataattgcataacttttatgctcagcaatgaaacttagaagaattgatccaagtgtataggataaatccatggaagataagaaagttccgttagcagctccttgcctattagaaggagatcggtttacagcccaagcttgaagagaaggctgaacggcaccatacccaagtccgtagaataaggaggagagtataagcattaaaatagagtttgcataggagagagttataagacctattattaagcaaattgagccgggtaatattactacagcatgtcctttttcgtcaaatatttttccaacaagaggccgtgttattaaaatcattgcaacaaatccaataaaataaatccaaatagaggatatttttagctcctgcccgtataacattatataactcataattccacataatgtgattacaagaaaaaagcataataaagaaggcaaggccgcttttttttcaaaggaatcttttaatgagcatttggaaatcgtattagatgttgaagagatttttatagttgatttaacttgactgagaaatataataccaatacctactaaagttattgaaataagaacaatatttttaaaactgtataaattcattattactattgcaaccataggggataatgccatggatattatcattgaaagagaatagtagcccatgccctcaccgcgtttctcttttggcacaatattagaaaaaattgcagcagcaccagtagaagcaagtccccaacctataccttgaatgacgcgaaccaatattattgcatctattggaagccagatatatgatagtgtgcttccagcaagtattagagcgcctaaaagcagtagaggtttgatttcgatcctatccataatattgcctatgaataatctaacaagtaaagaagttattgaaaatgtacttacaactagactagcttctaaattattaccgccacatagcttggcatatgcaggaagagttggagttaacatataaaaagctaagtatataaataaatttgaaagtagcataaatatataatttttggtccaaagttttgatgcattaaaatgattttttatttccatattgattcctccttttgtattataagctatttatatttttatcaatttttaaaagaactgcattatatacttccagtttttcaagagatatgtctttaagtaatttattaaataaatcttctaaaaaaggagaaacctctccaataatatttaaaccgctatctgttatatggatttcaaaggaacgtctatcctctttgcttggatgtctttcaataaaagcctttctttcaagtatatcaagtattctagctaaagtggactggtctttgcctgaaacttcagctaaaagtttctgacttattttattctttttagagagttttaatagtactgtccattgctcggttgtaatattaaatttttctaatttattatttagataagatgttaattttttagaaactttatttgtcaacattccaatatcttgatcataggattcaaacatataattacctccagtaaataaagttgttgtaaatataattgttttacaaatagttgctacaacaattaattataagtataattgaaaaaaaatcaagactaatttgattatagaataaaaactataatgaaaagaaaatttattaataataaaaagatccacattataaacaaagttatcaacagattctgttgataactttgtttataatgtgtgaacaacaacataaatatttaatacttatgccacttttatatttgattgataaagatatgttctactaatcaatcgagagatatatttagacggaattaatttaactgtcttgtctattttgagttataaattacttcaaattaaatgaatttaaatgttgctgaaggattttaataagtttatatagtgatttgattctctaagaacatgatcagcaaagagtggtagaattattgatttaattttacaagttaaaagcccttcagtactctgggctttgaaatttctgagattagtggctgcacttaaggtagtctcggtaagttcagacaaatcttctgctgatttatccatatcagaagcctcatctctcaatgccacgaattcttttccgaaattattagctatattgaataattctacttcggtaggatctagcattcctctaatagtaaatgaatgttctgctaacttatcatcccaaaagttttcaagtattagtatatctctcttagtaccaattccgacaccactttgcaatcgtgttagaagctctgtaaatattattgcttcactaagcacatggtttagaactgcagggtataaagtcgtaaatatcttacaagatagaacatcatttctaagttttgttttaaatttaataatcatattagttgcagctatagactggtggttaagcatatatacattatcggttaacatagatgtatcactatttctcatgccagatattaatgacttttccatagaagttatattagagtctataaaaattccagtagcaaattgagtagccttttcagcatccattgtatattttgtgcttatttcattggaatctaatgtttcgaaagggataactccatctgatagtaatatggcacgagagagtaaagttgtaaactcatttttaaaggcatcagcttgacttataagatctttgttctttggtggtagggctgcttcaataaatatcgagtgttcccgcataattcttagaaagaataagtttaattctaaagattggttaataaactcttgctttgatagcattttctactcctgaatatattctttatatctttattaatatattcaaaaataaaaattaagtgatatattaatttttatcaattcgcattattatggaagctgggtggtaaataatatataataaaataaaagttatatatactttaggatgaggtagataatgaataaagaaatattaactaaaggctttgatgaattagagctagaaaaagatattaaagaaaaagatgattttatattgattgataaagatggagttatattggaatatagagtcatttttacagagaaagagctattggaatatcttaatgaccataaaggtcatacagaaaatagaagtggcttattagtgacatttgaatgtaataatattttaggagaattttataatactatatttttaaagaaatttagatttgatagctattctaatctcaaaatggatagtcatttacgactgatacttaataattgtgaatttgttgaggatatagaattattagggggagattataaaagaataaaaatcaataattgcataataagaaataacatgtttgtaaggttcataaactgtgataagttaagaataagcgaaactgtggttaaagaaagcataatagtggagaattctgaggttggaaaattctatggaaatgcatctatatttaaagaaaatttgcttttccaagaagttaacatactgaatgattttatccttgacaaaattaaaggagaaaaggaattatgctttgttgattgtagatttgaaggattaagcaagttggagttagatataaatggggaattaagttttttgcagtgttctttttataaaaaatcagaaattaattttgatgatattaaaggtaagtttagtctgtataaaactaatttctcagataaatgttatctggaatatgaactattggaaaacaaaaagtacaagcctctgatttttgacaatgactttaagaaaacaaaatggaactttttgatcgtatcagatatatataaatctagtggaaggatagatcaataccttgaaacgctttattattttaagaagtatgagagattagagagaaaaagtaaaaataaaggtaattttaatttgctgtattatttaattggcataactacaaagtactatacaagttgggagagaacattattgtctatggtagtagtgattgtttcattttttctactatactgtttctttcctaatttgctgatgtgtaaggatgttcaattgaattcaaaaaatttattcataacagtatttgaaatgcttaagaattcgaattttgatgctaattttttaattagtaagtttggtaatacattatattttacaataataacatttacaaccgttggatatggtgatataatcccgctaaactggatgaagatggctgttagtttagagtcattcttgggagtgttttttacatcgagctttgtagtatctctatcaagaagatttatgtaatgaaagtaaatatgttaatttcaaagttaaagtcttaaaattaactcttgagaacttatgaatatcaataaaaaaatcactgcatttttgcggtgatttttatttatcaaagttcattagcttgacaaatagttattgaatagtatactgtatgttatacagtatggtgttcaatatgcagagcctataataataggaggtgaaaacatgggagaaaatgatgctaaagaaaagttgatagatgttactatacatatgatatgtgaaggcaaaaagcctagtgaaattaccgtaaaagatattaccgagaaggcaggacttggtaatggaatggtaaactatcatttccagagtaaagataatttaattcgtctagcagtaaaaaaggttatgagttgtgcaacgagatctttaagtgagaaaatgaaatcaaagagtaatgaatcatcaatttatagactcaccttcatattaaaagaagttgcaaactttattgcagataattctgaaatttctaagattgcgattttagatgacttagagaataatcagatgacagcacatttactagggtcagaagaggaatacaataagtgccttagggaactttatggagatgacacgcataaattttgggttaagaactacttaattgcaggatatttaaattacatattcttaaaggcagaaaatataaagaatgaaatgggatttgatttctataaaaaagaggatagagaaaaagcaattgagaatttagttaatgaattagccaattgtaatatgtctaagatgaaataggtaggcaaatttatataaatatattgtggatacttaaaaataataatagataaatttaatataaaaggagtaattatactatgatgattgtagataaagaaaagtgtgtgggatgtggactttgtgttaaagattgttttcctaatgatattgagataaatggaaacaaggcagaaatcaaaaatgttagatgtatgaagtgtggacactgtattgcagtttgccctaaaggagcagtatctacagatgaatataatatggaagatgtaaaagattataatgagtctgagtttaagatagaatcggagaaacttcttaattttattaaatttaggagaactacaagacaatttaaagataaagaagtagaaaaagaaaagatattaaaaattattgaggctggtagattcactcaaactggaactaatagtcaaaatgtttcatatgtagttgtggaagataatattgaattattgaaggaattggctttaaaaaacttaaaaactagaggggaagaaatacttaaaaatctaaatccacaaactttacctttcaagagatatgcacaaatgtggattaaaatgtataatgactataaagaggattctaagaagaatgataaattattttttaatgcacctgcgttaattcttgcagtttcagactcgactgtaaatgcttctttagcgtcatctaatatggagcttatgactaatgctttagaccttggaacattttttagtggattctttacaatggcagcacagggaaatgatgaaataagagacttacttggtttaaaaggtaaagaagaaattgtaacatgtatggttgttggatatcctaatgtgaaatatgttagaactgttccaagaagagatgcaaatatctcttggaaataggaattaatattatatagtaaaaatagagttatcttagattgggtttccggtataagatgactctatttttattgataaaaaattaaagatttttgtaatccagcctaattatttatgataataaaataattaggctaaattaaatattaaattagcttaacatttatctttgcaagtaaaagtgaatattaaaatcaaggatattcaattagcttattttcgactacttgaatatagtaaaatacaatgttatcatgaaaatattatatttagcctattaagttatattattacagataagttgtgtttatatttactatttgtagtattatgtatattaatgtagttaattctagagaaagataaagtttataggagtgttaatgaaatgaataggaatagtaaactgtttagaaagatagtgattggaattatcattatgcttctactcccaactgtaactgttggattagtagcaatttttaagtctgatgttgttttggagaataatttgaagactacaagtgttcaaactattaaagaagttgataaaggtttttcgcaatatctagaaattttgaatactcaattgagagtaatatcgaaaaatgccgatatcaaagatttatcaaatccgcaagtagatcatgcactaatatctaaatatgtacaaggtatgtttaaagatactaaggattcaataaatggaattattaatgcaggatatgcaactgaatatggagagcttgtattagatagtggaacgatgaatattaatgatttcaattataaagaaagggaatggtataagaaagctaaggaagctgatggaaaggttgtatacataaaaccatataaagatagcgtaacaggaaagcaagtaatgacagttgctcaagctgttaaagataataatggacaaatcaccggggtaatagtaatagatatgtctttagattctatgcaagaatatattagtaacataaaactactgaatacgggattcatagtactagtcgataacgatggagatgttgtagcaaataacaataataataaagagatagatgataatattagtaaattaccattttgggaatcagctaaggatgaagaaagaggagtatataattggaaaaataatgggaaagaattttatgcctgtcaagaaacagatgctttaacagggtggaaaatggtaggtataattgatggcaaagaagtaacaaataatgttttaacaatgaaggtaacagttattactgctaatttattatgtgtaattataggaataattatatcaatgatttcagcatcgtatattgtgaaagaaatacataaattaaaagaagcgtttagtacagtagctgaaggagacttcagtaaaagaataattgtaacggctaaagatgaattcgctgaacttggagataactttaattttatggtagagaatatctcgaagttattgaaaggaattcaaaatacatcatctgatttattggaggcatcaggaaatatatctagtatgtctgaggaaacaactgcatcagtatcagaagtttcaaatgcaatacaagaagtcgcaaatggagctacaaatcaagcgcaatcagcaacagaggttgcaacgagtactgaagaattatcaaataggatagatgaagttgatggagagactaatcatattaatgagttagctggtgaagctgagaaattaggtactcaaggattatctatacttaatgacttaatatttaaagctgaaaagtctaaagaaaatgcaattaagtctggtggcatggttcatgaaatgggagaaagtataaataaaataaattatatatcggatgtaatagcaggaataactgaacaaactaatcttttagctttaaatgcaagtatagaagctgcaagagctggagaagcaggaaaaggctttgcggtggttgcagaagaaatcagaaaactagcagaagaatcaaaaaaatctacagatgaaataaaagcaattgtttcagaaataaataataagagcgattctactaaagtagctatgaaagaaagtagagaaatgtcacagaaacaaggagaagcaataaaggaaacagaaagtatatttaataaaatagttgattctataattcctttaacaggagcaatagaaaatattaaggtattaaatgaaaaaatgaatttaaataaagaggaagttaagacacaaattgaaaatatagcagcggtttcagaggaatcagcatcaatatcggaagaggttacagcatcagctcaggaagtaaatgcaacaatggcagaattaacagagtatgctggcaatttgcagcaaatatcatataaattgcaagaggaattaaagatgtttactgtagaatagtattttaaataggaagacattgatataaagaaagccgtcttttataagtgtatataaatatatttagacacttataaaagacggctttccctatataagatattatttttactacatcatttctaacatttgttttattattctagtagaatttttaactgcgattggtacaaatttctcataatccatatgagcaccattatttgcgttatcagaaatagatcttataactacaaaaggaattgcgtttagatagcaaacttgagctatactagcgccttccatttcacaagatattgctccaaactcctgatcaagccaatgaattttttctatatttgctatgaattggtcaccagaagcgattcttcctgtaaaactatttaattctgcaattttctcgcatgcattcttagctatagaaaccatttctttatcacatttaaagtcaaatgtatcgagtcttggaatctgcccaaccttatctccgaaagctgtagtatccatgtcatgttgaactaaattttcagcaacaacaatatcaccaggataaatttcttttcctattccaccagcaactcctacattaataattttatctactttgtattcagatgctaatatttgagtgcaaatagctgaattaactttaccgataccgcaaactacagctacaacatcttttccatataattttcctttgtggaaagtcatattagccttatcttttttttcttcaatagttaaatcatttagtaatagttctaattcttctgccatagcagcaattattccaataatcatatataaagtgagcctcctaaaataattaattaataaatatgatataacctatgtatatatttaattattatgtaaatttattgagtaatatatagaaactaaaaatgaacaagttcttaatatgaacgaaagcagtaaatttcatcatatctatactaaattcaataaattatagtaaaataaatattttggttaaacatatatgatacttaatatatattataatcattagtttgacaatttaatagataaatttgtaaaattatttgtgcactccgtgtgagggtaaaagaaaagctttggtattaattaacatatatatgtaaataatcattattaaggctataatatataataattatactgccaattttcgattgtttttgtgttataatatcaattaaaagtataagataataaggagagaaaatttatgacagcacaacattctttatcaagaactgaacttttgataggtaaagatggattagataaattaaaaaatagtaaagttattgtttttggagtaggtggagttgggagctatactatagaggctcttgcaagagcaggagtaggtgaattaatcattgttgatgatgatactgtttgcttaacaaatctaaatagacaagtgcatgctacctataagacaataagtcaacctaaagtagaagtaatgaaagaaagaatattatctataaatagaacatgcaatgttataacacatcaaatttttgttacacaagaaaatatagagtctataattcctgatgatgtagattatgtagttgatgcgatagatacagtgtcagctaaattaggattagtagaatattgttataaaaaaggtataagaataatgagttctatgggaactggtaataaattagatcctacacaatttaaagttacagatatatttaagacaaaaatctgtcctttggctaaggttatgagatctgagttacgtaaaagaggaatagaaaaattaaaggtagtatattcagaagaagttccgataaaacctaactatgatgatgttgttacatgtaaaacaggatgtgtttgtactggtggtactaagaagtgcgctattaaaagacaaataccgggaagtatatcattcgttcctccggttgcaggaatgataattggtggagaggttataaaagatatattagaaataaagtaatactagattcaggtattggtctaaaagcttcaagtatatagtaaatttatagtgattgattttaactgactcttttggtgaagtatattgtattttttttagtaaaaggatactatatatttacttgaaagagttagtttttttattaattatagacaaatctaaaagaaggtgagcatcatgaagcgtattgatagaatttacaattatatcgaaaataactcaaaaaaatttacaaagaataagctcttagaggttaaaggatttagcgcgcaagaaataggagaatatcttgaaatattaagaagtaacgtatcaagggaacttaatacactatgtagagattccaaaattatcaagattaaaaatagacctgttctttactttgatagaaaaagttttgaggaaatattatctgtaaagttaccagacgacttggaagagatatcagatataatgaaatttgcctcgagtgaagatgtggtaagagatgaagagcaatctccttttaactatttaattggagctaatactagcctaaaaaatcaaatcgaacaagcaaaggctgcgctcctatatcctcctaatggacttcacaccttgataattggaagtacaggagttggaaaaagcttatttgttaatataatgtaccagtattcaaaatatataaaaaagttacctgaagatgcgccttttgttgttttcaattgtgcagattacgctaataatccacaattacttttatcgtatatttttggacatattaagggggcgtttacaggagctgataaggaaaaagagggaattgttgaaaaggctgatggaggaatactattcttagatgagatacatagattaccaccagaagggcaagaaatgattttttattttatggatacaggaacatataataagcttggagaaacagataggcagcgtaaagctaatgtattgttaataggtgctacaacagaagatcctaattctacattactaaatacttttattagaagaattcctataaccatagttattccgaattttgaagagagatcattacaagataaattagaacttatacactatttactttctaaggaagctcaacgggtaaataagactattaaaatttcatcggagtcgataaaagcattaattggaagtacaacatatggaaatgtgggtcaattaaagtcaaatatacagctagtttgtgccacaggatttctaaattgcatgaatacagataaatgtattgagataaatttagatttactaccagaaagcatgagaaatgggatacttaattttgaaggtaaaataaaagatgattccaatttttggggaagggttcctagtacattagtggttaaacctgatggtaacaaaacttttttagagactgacgcttatgagccaccatttaatatttacaatattatagaggacaaggcatttgttttacaagaagaaggtatgagtgaccaggatattaaaaattatataacaacagatataaatgttcatttaaagcaattttatgctagattcaagaatgatgcgtatcgtagagaaggtttactgaaaattgttgataaagatattgttgattttgctgaagaaataaaaatgttagctgaaaatagattgagcagaaagttaagtgatagatttatatatgctataagcctacatttcagcgcgttatttaatcgtataaagaaaaacacagtatcattttcaacaaatattgagttaacattatcatctaatagtaaagaatatggagtagctaaagagattcataagttaatagaggatagatataacttaataattccagaagttgaaatagaatatttagctttacttctaagctcaatacaagaattatcacatcaagaaagagttggaatagtagttgcatctcatggtacaagcactgctacaagcatggtggcagtggctaaaaaactttttgatgcagataatattgcagcagttgatatgccgcttgaaagaaaacctgctgatattatagacagtgttattgaaaaagttaagcaagtagatgaagggaaaggtgtattacttttagtagatatgggatctttaaatagttttggtgaaactataacgaaaaagaccaagataaatattaagagtattgatatggtatcaacggctctagtactagaagcagtcagaaaatgctcaatttttgatgctgatctaaattcagtatattcatatttaattactgattttagaggatatacgaataatatgatgacagaaggtaaaatgcgagaagagaatgctataattacaatttgctcaacaggtaagggcgctgcaattaaactcaaagagttagttgaagctgtagcaaagaatatctcaattaacgataatgttagaataatcccagtaggattaaataatctaaatgagtcaataaaacagatttcgcggaaaaataaaattttagcacttgtgggaatagcaaatcctaatatggggattccctttatatcgattgaagaactaattgatggatctggagaaaatattttaagaaatataattgaaggaaaggatattaatccggttataaaaggagaaaatcagattgttttaaaaaatctttgtaagcaaactttaacagagattttaacctttcttaatcctgaaaagatatattcgttattagatgattttataaaatctatcgaaaaatctttgaatgtacattatgagaatccaactaaactaagaattatgtttcatgttgcatgtgcattagaaaggatgcttttaaataatggactggtatatgattcatctgattcagaattaaatccaagatatctggaagtgttaagaagagcaaatttaatatttaaagaagctttatcaatagagctgacggatgatgagctatactatatgattgatgttatagatgtgtgttaaatttagtttatataagaaaaataatgtgtcaaaatacaattaaaagtgtgtcaaataatactttagagtgtcaaggtgaaaacttatccgcattgtatgcgtttagaattcatgtttggagaaaagtatttgttgacacactttttttggcatgggaattgctaggtatattggtatagaaataatatatgtagcaggaaaggatgatgaaataatgatagcagtaatcataggtactcatggtatattctcggaagaaatcctgaaatcagctgaaatgatttttggagcccaagaaaatgtgggaagtgttacttttcagccaggggagggtatagatgctctagttgaaaaatataattcacttatagaaaaaatgaactcaacagatggcgtattgttcatggtagacctttttggaggaagtccatttaatgcagcgagcataattgcaatgaaacatgagaatatggaaattgtgacaggtgttaatctcccaatgatattagaggttctaggaagtagagatttttcaagtgtgtcagaacttttatcaattgcagaaaattccggaaaggaggctataagaactttatctaaaaatattgaagaggatttagatgatgagataatatagcaacctatgattagttagtataagaattacatgaatttaattataatatgaaatttgaaaggtgagatataaagatggaaattagttttgtaagaatagatgacagattaatacatggacaagttgcaacagtttggacaaagtatagtggatgcaatagaatatttgcctgcagtgatgaagttgcagcagatgacttaagaaaacaattagtaattcaagtagctcctccagggataaaagcatatgtgcttccaatagcaaaggcaattgaagcatataataatcctaaatttgacagttttaaaactttattcttatttacaaaccctacagatgtattaagaatggttgaaggtggagtacctattgaatctgtaaacgttgggggaatgtgctataaagctggagataaacaggttacaaatgcattgtgcatgaatgatgttgatattgaggcatttaaaaagcttaatgaaaaaggcatcgaattagaggtgaggaaactagcaaaagatcctaaagtaaatttgatggacaaatttaaagaattacaacttatatagacataaattttacctaaaaaccaaagataagatcctttaaaaactcttagattttgatagaaggaataataaatcctgttaaaagattagatatataaaatttaaaaaagtttttatatataaattaaaagaaagaggggaatttacaaatgagcactttacaattaattttattagtaatagttgcagcaattactggtatggcaagtgtacttgatgaggcacaatttcatagaccaataattgcatgtacattggttggacttgtactaggggatattaaaacaggaattatactaggtggaacacttgaaatgttagcattaggatggatgaatgttggtgcagctatggcaccagatgcggcacttgcaagtgtaatttcagcaatacttgttataatcggtaaacaatcaattggagcaggtatagcagtagcagtaccaattgcagctgcaggacaagttcttactatatttgtgagaacaataactgtatttttccaacacttagctgataaatatgctgaaaagggtaacacaagaggaatagaaatgtgtcatatactagggttatcacttcaagcaatacgtgtagcgataccagcagccatagtaggagtacttgcaggaacagatgcagtaaatgcagcacttgcagctataccacaagttattacaagaggacttcaagtgtcaggtggatttatagtagttgttggttatgcaatggtaatgaatatgatgaatagtaaatcattactaccattcttcttcattggattcctattagcagcatttacaaacttcaatttaattggttttggtgctgtaggtgttattgcagcaatattccatataaaatcaatagctaatgaaggtaaagtagcggtagctggaacaggaagtattgatgatattgatgattcagagttaatgtaagtacagaaaggagataaaataatgagtgaaaagaaattaaataaaagtgatatagtaaaaatgtttatccgttcaaatttcttattgggatcatttaattttgaaagaatgcaagcaataggtttttgtgttacattaattccagctttgaagaaattatataaaggtgacgaattaagtgcagcacttaaaagacatttagaattctttaatacacaaccatttatggcaacgccaattatgggaataacagctgccatggaagaacaaaaggcaaatggggcagatatagatgaggcatcaataagtggtgttaagatcggtcttatgggaccacttgccggagttggagacccaatattctggggaacactaagacctgtacttgcagcattaggggcaggacttgcacttacaggaagtataattggaccattaattttcttcataggattcaatgcaataagacttgcaacaaactggtatggaatgttctatggatatgaaaaaggaactcaattagttgctgatatgggaggaaataaacttagatatcttacagaaggtgcttcagtacttggattacttgttataggtggtcttgtttcaaaatggacaactgttaatataccttttgttctctctaaatatacacaagctgatggaaaagaagtagttacaactattcaaagtgtactagacagcttaatgccaggattagttccgcttttactaacatttttatgtatgtatctattaaagaagaacgtgaatccattaataataatctttggattatttgcagtaggtattttgggcgtagcttgtggaatattacagtagatatataaacatcaaataaataaacggttaaattagataatatagtaaacttccttaaaaatagaacccgcaatatattaacatggtatgtagaaatatcaacaatatattgtgggttttgtgtataagtatgtactaaatccgacttttgtggataaaatttatgcattaggtctaagtatatagctacaatagtaaatttgcatttgatatctgaataatgtaagttcacaatcaagattaaatctagaaaaccaatattagtatatatggtgctataaaaatatgaaatatataatctcttatatattttaaaaagagagggttatttatgaaactagagtataattatattgcttttctaattatcaatttttagttagtgtaagaagggcgtatagggttatgaggtggcacttatgtaaccagtaataatcttctatatagaatttagggaaatataattgataagagtaactaagattacagcaaaaaggaaaattaaaataagtgttgaatgattatataggaatgttgaatagtgaaattgaaaataataaataatggattaagaatcgagaagacagattttcataattgtagaggggaattatatggaatcaaacatgaaagtaaagatacaaggaaatagatcgaataaaacagaatatttaataagagatatggatgatattatcattggtagattcagtactgatgaattaactgacagaagcaaaacatgcaacgtcaatcttaagttctatagagaatataattatgaattattaagtgatacactatcgcttatattaaagggaatatttaaagattcgaatatttttaaggttaacataaaagttcttgaaaaaatagacttaactgcatttttagatctaggttttactctagaaggaatatttaatgaaaatgaatattttcaaggtgaatatcttgatgaactgtcatttggtataactagaattgaatatgaccaaatgtgcaggtattcattagtggaattaaaaggggaaaatataattcttagaaatctgactcctagcaatgctcaagaaatgttggattattataaaagaaataaaaattacttggctcctttcgaaccaagtagagatagtgatttctacacagttgagacacaaagaaaattgttaaataagagttataaggaatttttgaatggaacaagtgtagatttgggtatttttaaagaagaaaaattgattggaaagataaaactttcacgaattatatatggatcgttgaagaatggcatattaggttattcaatagatgaaaatgagcaggggaatggctatatgcaagagagtgtaaaactgctactaaattatgcgtttaaagaatgtggtcttcatagaatagaagcatcagctttgataaataacaaaaaatccaaaaatgtattaactaaatgtggattcagattaattggagtaaatgaaaaatatctattaattaatggaaagtgggaggatcatgagacctattatatattagaagaatatttaaataactattaactatacctagcgtatcaatagtagaaatgagaagaaaaatggagtttggtataggttttaagatttaaatggtataaatgatgatttttgtcagaatggctaatagactatgtgttaagataaaacacgtcgctaagagacataaacaaaacaacttaaaaggaaaaagattttctaggaaagttgttgacaatgtcgaatggtgatgatatgataaaatcctcgctaagagatgcaaaattaataacttaaagctaatagaactgctgaaaaatgagttcgaaaagttttttaaaaaagttgttgacaagcttcgaaagcggtgatatactgagtaagctgtcagaaacgacagataacaacaaaacattacaacagtagttgtaagaaagaaaaattggtctttgaaaattgaacagaatgatataaatacatttaagtaaaccagcaatttttatttgagtaagctaagattaaactttttattgagagtttgatcctggctcaggacgaacgctggcggcgtgcttaacacatgcaagtcgagcgatgaagttccttcgggaacggattagcggcggacgggtgagtaacacgtgggtaacctgcctcatagaggggaatagcctttcgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgctaaaccgcgaggtggagccaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgtaagcgggcagcgacctaaggtagggtcagcgattggggtgaagtcgtaacaaggtagccgtaggagaacctgcggctggatcacctcctttctatggagaaatctagatcagcatgatgtctgactagtacagatacattattatgtatcaaaatataaaatacttgctcaaaggttacttaagtatttgttctgttcaattttgaaagactaagtctttcaatgttctttgaaaattgcacatagatttaatgtatataaaatacaacaaagccaagaataaatattctttgtgatatgactaataattaggtcaagctacaaagggcgcatggtgaatgccttggcatcaggagccgatgaaggacgcgataagctgcgataagcttcgggtagacgcacatagtcagagatccgaagatttccgaatgaggaaactcacatgggaaaccccatgtatcataaagtgaatacatagctttatgaaggtatacccagggaactgaaacatctaagtacctggaggaagagaaagaaaaatcgattttcttagtagcggcgagcgaaaaggaaagagcccaaaccagagatttatctctggggttgcggacagaacataacgagaaatcatagttaattgaacacaactggaaagttggaccacagtgggtaatagtcccgtaagtgaaaactatgataatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcagagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcggaaaatgtgagtagtggaggtagagcactgaataggctagggggcatagcgcttaccgaaccttatcaaactccgaatgccacatactatcagtccggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcacgtttaacgtgagcggtagaggagcgtcgtaatcgggctgaagtcgtaccgtaaggagcggtggactgattacgagtgagaatgttggcattagtagcgagatgtaggcgagaatcctacaggccgaatatctaaggtttcctgagtaaagtttgtcttctcagggttagtcgggacctaaggcgaggccgaaaggcgtagtcgatggacaattggttgatattccaataccactataatcgttattatcgatggtgtgacggagaaggataggatgtgctagctattggatgctagtctaagcgtttagggagttgggattggcaaatccgttccaacaattctgaggcgtgatggggaaggttctacggaaccgaagtatctgattccatgcttccaagaaaagcatctagaaagagaagtagtgcccgtaccgcaaaccgacacaggtagatgaggagagaatcctaaggccgacggaagaattgcagttaaggaactaggcaaattgaccccgtaacttcgggagaaggggtgcctgagaaatcaggccgcagagaataggcacaagcaactgtttaacaaaaacacaggtctctgctaaagcgaaagctgatgtataggggctgacgcctgcccggtgctggaaggttaaggggaacacttagtggtaacgcgaaggtgtgaacttaagccccagtaaacggcggccgtaactataacggtcctaaggtagcgaaattccttgtcaggtaagttctgacccgcacgaatggcgtaatgacttgtgcactgtctcaactgcaaatccggcgaagttgtagtgcgagtgaagatgctcgctacccgcgattggacggaaagaccccgtagagctttactgtagcttagcattgaatttcggtattgtctgtacaggataggtgggagactgggaaactagggcgtcagccttggtggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgaagagtgtaaaggcagaagggagcctgactgcgacacctacaagtggagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtatggtaacatatttagctgactgatactaataggtcgagggcttgaccaatatagtcaagttgtaaatacattaaagaaactgtgtgcaattttgaaagaacaaagttttttcaaattgaagatctcgtgatgatggcatagaggtaacactccttcccattccgaacaggaaagttaaggtctatagcgccgatggtactgcatgggagactgtgtggcagagtaggacgttgcgaggtaagcaaaaaagatagttgtaataactatctttttttattttataatatttaggaatggtaagatgataagtttcgccgctgtatagctggattatttaatgccgtatttctaaaaaattcaataagtatgacgattttgtataactcatttctctaaatcattacgaaagagcttattaattcaatgtattcttaattctacaactgaatttctatcctaagcacatatttaagaccgtatatttttacgataagccttttttgatagagttcattccttatataacattaatatctattctgaacaacaaagtagttagtgagagattaacaactttgcagactaatcttattataatatttcatattaactttatagtttaattttttatgattaaaaactcatttagtagagcatattttctgttattatatgaaaaagtttttatgtttgatgaaattttatgtatccaggggtaattggatcctttcatgatcataagatcttttattattttgaacttaatttcttattaataaagatatttagaattattaggaatgagataattaggctaaaaaacatatataaatgtaatagattgaaccaaattggagtgacaactattgctagcgtatcagtatgtataaaatctagaataatgacgtattataaagaaaaatgaaaataatcgcatttagtaataggaaagcaaataatatgaaaatatcagagatgttaagataaaacacgtcgctaagagacataaacaaaacaacttaaaaggaaaaagattttctaggaaagttgttgacaatgtcgaatggtgatgatatgataaaatcctcgctaagagatgcaaaattaataacttaaagctaatagaactactgaaaaatgagttcaaaaagtttttttaaaaagttattgacaagcttcgaaagcggtgatatactgagtaagctgtcagaaacgacagataacaacaaaacattacaacagtagttgtaagaaagaaaaattggtctttgaaaattgaacagaatgatataaatacatttaagtaaaccagcaatttttatttgagtaagctaagattaaactttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgctaaaccgcgaggtggagccaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgtaagcggggcagcgacctaaggtagggtcagcgattggggtgaagtcgtaacaaggtagccgtaggagaacctgcggctggatcacctcctttctatggagaaatctagatcagcatgatgtctgactagtacagatacattattatgtatcaaaatataaaatacttgctcaaaggttacttaagtatttgttctgttcaattttgaaagactaagtctttcaatgttctttgaaaattgcacatagatttaatgtatataaaatacaacaaagccaagaataaatattctttgtgatatgactaataattaggtcaagctacaaagggcgcatggtgaatgccttggcatcaggagccgatgaaggacgcgataagctgcgataagcttcgggtagacgcacatagtcagagatccgaagatttccgaatgaggaaactcacatgggaaaccccatgtatcataaagtgaatacatagctttatgaaggtatacccagggaactgaaacatctaagtacctggaggaagagaaagaaaaatcgattttcttagtagcggcgagcgaaaaggaaagagcccaaaccagagatttatctctggggttgcggacagaacataacgagaaatcatagttaattgaacacaactggaaagttggaccacagtgggtaatagtcccgtaagtgaaaactatgataatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcagagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcggaaaatgtgagtagtggaggtagagcactgaataggctaggggcatagcgcttaccgaaccttatcaaactccgaatgccacatactatcagtccggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcacgtttaacgtgagcggtagaggagcgtcgtaatcgggctgaagtcgtaccgtaaggagcggtggactgattacgagtgagaatgttggcattagtagcgagatgtaggcgagaatcctacaggccgaatatctaaggtttcctgagtaaagtttgtcttctcagggttagtcgggacctaaggcgaggccgaaaggcgtagtcgatggacaattggttgatattccaataccactataatcgttattatcgatggtgtgacggagaaggataggatgtgctagctattggatgctagtctaagcgtttagggagttgggattggcaaatccgttccaacaattctgaggcgtgatggggaaggttctacggaaccgaagtatctgattccatgcttccaagaaaagcatctagaaagagaagtagtgcccgtaccgcaaaccgacacaggtagatgaggagagaatcctaaggccgacggaagaattgcagttaaggaactaggcaaattgaccccgtaacttcgggagaaggggtgcctgagaaatcaggccgcagagaataggcacaagcaactgtttaacaaaaacacaggtctctgctaaagcgaaagctgatgtataggggctgacgcctgcccggtgctggaaggttaaggggaacacttagtggtaacgcgaaggtgtgaacttaagccccagtaaacggcggccgtaactataacggtcctaaggtagcgaaattccttgtcaggtaagttctgacccgcacgaatggcgtaatgacttgtgcactgtctcaactgcaaatccggcgaagttgtagtgcgagtgaagatgctcgctacccgcgattggacggaaagaccccgtagagctttactgtagcttagcattgaatttcggtattgtctgtacaggataggtgggagactgggaaactagggcgtcagccttggtggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgaagagtgtaaaggcagaagggagcctgactgcgacacctacaagtggagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtatggtaacatatttagctgactgatactaataggtcgagggcttgaccaatatagtcaagttgtaaatacattaaagaaactatgtgcaattttgaaagaacaaaactttcataaggaatacaaatcgctaaaacgatttgcataagtttttcaaccaaatcagagatttgggaaaagctaatatctcgtaatgatggcatagaggtaacactccttcccattccgaacaggaaagttaaggtctatagcgccgatggtactgcatgggagactgtgtggcagagtaggacgttgcgaggtaagcaaaaaagatagttgtaataactatctttttttattttgtaatatttcgcacttttaataagtaggctctatggtattaattgattcatgtgcttgaattgtatcatttgaaatatatgaataattataaagtttaaggtaatatattaaaattgttttaatactaattgttaaagagaggattcaagatatggattctcttttttttatggcatgaattttggtaaattaaacactattatcattggttagatagtgaagatcgccctctgatcatgattttaaaaagatatataagtgacatgagtttaaaatcatttttccaatattaaaaacttagcagaataaaacttaggtgctgctcactttatttcctaatacacagcgtcttttatgcgcttgattattgctattctgtgaattaattttaaatttaataaaatgaatgattgaatattatacattatatatggataaaaatatatatttattatcttaaaagttaaattaattataatttttattaaaaataaagaaaaataagtgaaaagtaccataaaatttggtaagatatatatatagtgagaattataataaagagaagcatttaatttagtttatgagagggatatgaatatggatgggggtatagtttaatgcaaaatgatcctaaaagcagtaagattaaagataaagatgaaataggtcctagagatatgaacggtttgacagaagaagacggaaaagtatctatcgaagataattcatctgttgagaaaagaataagtaagacaaagggaagagcgaaaaagaaaatttcctcaaaggaaacaactgaattaaatccaattaataatctagatattaaggtaaaagacattactacaaatgataaagaaattggtattaaatctaaagggagtttaaagaaatctaaggcaattgataagaagaatgcgttggagaataaaaacgaagaaaaaattattttaaaagaagagaataataaagaatcagaattggagggtggagataatattaataaatctaaatccaccaaaacgaatgaattaaatgtacaatcaaagacaaaaagaacaactaataaatcttcaaaagggaaatctgcagtaacttcaacaaaagcaagcgcaagaaaaaaatcagcttcaaaagaattaatgggagaatttcaagcagaaggggagaagattgaaaagtcgaaaacagaacatagtaaaattaatgttaaaaagagaacagaaagtattgataaatctgaaataactaatcttaacacatatttgtttcatcaaggtaaaaactatgaatcttataatattttaggctcacatattaaaactgagaaaagaaagaaaggtgtgcaatttgtaacgtgggcacctaatgcaaaagatgtatatgtagttggggattttaataatttcgaagtaaaagaggaatacaaacttgaaagaataactgaaaatggattatggagaggctttttttatactgcgaaggccggaaatagatacaagtattgtatagtgggaagcgatggagagatgggagaatacaaagccgatccgtatgcaatacaaagtgaattgagaccagataatgcatcaatagtatataagcctaaagctttcaaatggaatgataaaaaatggattgatcaaagaaataaaataaatgtacttgagcaaccattaaatatatatgagatacatttgggctcatggaagacaaataaagatggcggattcttaaaatacgaagaaatcgcagaagatttacctaagtatgtaaaagatatgggatatacacatgtagagcttatgccgcttattgaacatccattggatgcttcttggggatatcaggggacaggttattattcaccaacaagtaggtatggggattatgaaggtattaaaattttaataaataaattgcatgaggctaatataggagtaataatggattgggttccaggtcatttttgtaaggatgctcacggattatataagtttgatggaacaccaacatacgaatatcaagaagaatggagagcggaaaataagggttggggaacttgtaattttgatctaggtagagatgaagttaaaagttatttaatatcgaatgcattatactggtataaagagttccatattgatggattaagggttgatgctgtatcaagcatactttacttggattatagcagatcgcccggggaatggataccaaacaaatatggaggaaatgggaatttagaagcaatagattttctaaaggagttaaataaagcagtatttgcagaatatccgactgcacttatgattgcagaggaatcaacatcttggcctaatgtcacaaaacctgcaatttatgatggtttgggattcaacttaaaatggaatatgggttggatgaatgatacattagagtatgtcgaaatagatcctaaatatagaaaacataatcataaaaatataacatttgcgatgatgtataattatgctgaaaattatttattaccactttcacacgatgaagttgttcatggtaagaaatcattggtaaacaaaatgtggggagatgaatggaataagtttgcaggtctccgagcgtttatgtgttatatgatgggacatccgggcaaaaagttatcgtttatggggtgcgaatttgctcagaaaattgagtggagagaatatgaggaattaaaatggaacctaatcgatgatttaggaatccataaaaaaactcaattattttttaaggatttaaacaatctataccttaataataaagctttttgggagctcgatcatgactatagaggctttaattggatagaagccgataataatgaacaaagcatattaatttttgctagaagaagtagaaatgataaagatacactgatttttataattaattttacttctattgtgtattatgattatcaaattggagtaccatttttggggagctatgaagaagtatttaattctgatgatagtaaatatggtggttcaggtcagattatgggtgaaatgcttgtatctgaaaagactcaattccacaatcaaccatattctttgaaagtaaaagtgcctccaatggcaacattaatattaaaagtgaatgaaattaatgtagatcaagaaattaaagaaaaagatgaataaaaggttaaaaagaccgtttgagaaagtaaatattataaaaatatctatagtataatgatataaatttatttgctagaggttgaggggataaagaatgagagttttatttgtagcatctgaggctagtccgttcattaaaacagggggctcggagatgttgctggggcattaccaaaagcacttgcacaaaaaaatgcagatgtaagagttgttataccaaagtataaagaaattagttgggaagtaagagacaagctaaggtttgttaaatggtttaatgttaaagttggatggagagaacaattttgtggcgtatgggaatgctttcataatggagtaacatattatgttttagataatgaagcatattttaagagagatgaagtctatggattctatgatgatgcagagagatttgcgttctttgatagggccgtattagacatgttgaggcaaatagattggcagccagatcttatacactgcaatgactggcaaactgggatgttacctgtactattaaaatttgaatataaaagaaatgatatgttctattggaagatgaaatgcgtatattcaattcataatatagcatttcaaggagtatttgatcctcaaatattaccggagttatttggatttgatatggagctttataataacacatgcttaaaatttgatgatggcgtaagttatatgaagggtggattatgctattcagatgttattacaactgttagtaatacttatgcatacgaaatacaaacacctgagtatggtcaaagattggatggagtattaagagagaggtcctatgcattaagaggaataacaaatggtatagattatgatgaatttaatccgaagacagataaatttattaaaaagaactatagtataaactctattgaagataaagcaataaacaagacggagttacaaaaagagctagggctaactgttgataaaaatataccaatgctggcgatggtaactagattgacaagtcaaaagggaatggatctattagtaaatatttctgataaactattacaagaaaatgttcaactagttattctaggaacgggagataagcattatgaggaacattttaaatggctagattctagatatggaaataaggtgtctgctaatattaaatttgataatgggttagcaaataaaatttatgcagcatgtgatatgtttttaatgccttcactttttgaaccatgtggattagggcaattaatagcacttagatatggttctattcctatagttagggaaactgggggactcaaggatacaataactgcatataatgagtatactggagaaggtaatgggtttagtttcagaaattacaattcagatgagttatacaatataatagaatatgcgttatggatatataaggataagggtaagtgggaaaatctaatcgaaaatgcaatgaattctgataatagctggaataggtcagctcaaatatatttagatttatatagagaattaacaggacaagattaagatgaggacataatgttatgagggggtatatcaatgctcgaaatggataaaaaaacatttaaaaaagcttatgtaaataagtttttagaaatgcatggtattgagttaaaagaaggaactaatcaacaaaagtatgatgctttgggaagcttagtaagggattatgttacaagaacttggcttaaaacaaataaaaaatataataagactggggagaagcaagtttattatttttctatggaatttttactgggacggttacttggagatgctttattaaatataggcataagagatatatgtaaagaagcgttatcagatttaaatataaatttagaagagttggaaaacttggagcaagaccaaggactaggtaatggtggattgggaagacttgcagcatgcttcttggattcaatggcatctttaaatattccaggaaacgggtgtgggattagatataaatatggattttttcagcaaaaaattatagacggaaaacaagttgaggtatctgatgattggttaaagctaggaaacgtctgggagaagagaaaagcagaaaaagcagaaattgttaagtttggtggagaaataaaagtaagcgaaataaatggacgcttaagctttatgcatataaattatgagcctgtattggcagtcccatatgatactccaattgtagggtacgaaaatgaaattgtaaatacccttagattatggagtgcggaggcggtttcaaacgagtttgatttttcatcatttagtagaggtgattttctccaagcaattaagtataaaaattcagttgaatcaatttcgcaagtgctgtatccagaagattcattttatgaaggtaaaatgttaagattaaagcagcaatatttctttgtttcagcgggagttcaaagcattataaggcactgtaaaaagcatggaaaagatatattgttactagatgaaaaagtagcgattcatataaatgatactcatcctacacttgcgataccggaacttatgagaatattattggatgaagaagggttagaatgggatacggcttggagaataacaactaatacaatatcgtacactaatcacacaattttggcagaagctttggaaaaatggccaatagatatgtttcaaaaattgcttccaagaatatatatgattgttgaagaaattaataaaagatattgtgcagaacttttaactaaatatccaggcaaccttgaaaaagttagaagaatggcgataatagctgatgagcaagtcaagatggcacatctagcgattgtaggcagtcatagtgtaaatggggtagcaaaacttcatacagaaatattgaagaaaaaagagatgacagacttctattatctttatccaaataaattcaataataaaactaatggaattactcatagaagatggcttttaaaaagtaatccagagcttacaaaactaattaaagatacaattggagatagctttataagacatccacttgatctaaagaactttgagaggcatttgtatgatgaagtgattctagaacagttaggaaaaattaaaaaatttaacaaagaaaagctagcaagtataatattagagaatgataatgtaagagtggatcctgattctatatttgatgttcaagtaaaaagaatacatgcttataagaggcaagtacttaattgtttaagaataatggatttatataataaattaattgatgatcctaattacgatatagttccaaggacattcatctttggaggaaaagctgcaccaggttattatttagctaaaaatactattgaattaataaattgtgttgcaaacaaaataaataatgattctagagtaaatgaaaagataaaagttgttttcattcaaaattatagagtttcactagctgaacaaataatcccggggacagatgtaagtgagcagatctcaacgacaacaaaagaagcttcaggaacatcaaatatgaaatttatgatgaacggagctatcacagtagcaacattagatggggcaaatattgaaataaaagatgaagttacagatgataacatagtgatatttggattaactgcagatgaagtattgaattattacaaaaatggaggatataaatctattgatatatacaacaatgatattagagtaaaaagggtaattgatgatttaataaacggaaaatatcatagtgataaaaataaatttagaagtatatatgaaaatctaataaattataatgatgagttttttgttttacaagattttgactcatatttaaaagctcaagataagattgatactctttataggaatgctagtaagtggcaaagaatgtgtggaattaatattgcacattcagggatattctcatctgacagaacaatagaagaatatgcaacagggatttggggatcagaggtaatctataagaatctataggaggattaactgaatgaatgatatacaggtattacatgactctcaaagcataagatttagaaggccctttggcgctgtagaggctggtcaaaaggttaagatatctattaatattaataaagacataattgtagcaatcgaattgataaaattcgatggaactaaaatgaatatgggaatgaacaaggaatatttaaataatggtgaatttaaatattctgtagaaattgatacatctgatgctttggggatattagaatactattttattttaatagatgggtatgacagagtatattatggaaataatgacaatcacttgggaggagttggccaaatatatacttataatcctgtgccatatcaaataactgtatatgaaaagtcattcgtaccaagatggtataaagagggtgtaatatatcatattctaatagatagattctataatggaaatgaaaataaaattatagataatataaaaggaaactcatttatatacggaagatgggatgatagtcctatgtatattagagatagttttggaaaaattgctaggtgggatttttatggaggaaatctaaaggggataataaagaaattagattatataaaggaattgggagctaatataataaagttaagcccaatatttaaatcccctagttgccataaatatgatacagcggactatgaaattgtagatgaaatgttcggtacaaatggtgaatttagagaattatgtaaagtggcaaatagtaaaggaattaaaattattctagatattgtactgagctatacaagctccgatagtaaatattttaataaactaggaaattacgacgatgttggagcgtataattcaccaaactctagattttatgattggtataaatttattacatatccatataggtatgaatcttggtggggaatggatgatagaccgaatgttaactcgatgcaaaaagaatatgttgactatattataagtggagataattctattataaataagtggacagatatgggagttagcggatggtttttaaatgtgacagatgagcttccagatgaatttatagaactaataagaaagaaaatcggagaaataaataaggatactgtacttttaggtgatatatgggaagacgcatctaataagataagttattcaagaagacgaaaatatttacaagggaatgaagtgcaagctgcaactaattatcccttaagggaaagtttaattaattttatcaaggggtatataaagtcagataagttaagacaaaaaattatgtcattgtacgagaattatccaagagaaagtttttatggaaatataaatattttaggtaccaatgatacagaaagaattttaactgttctggatgaaaatatatcactgttaaaattacttatagcaattcaatttactttgccaggagtaccactaatatactatggagatgaagccggcataaaaggtggaagagagcctgataataggagaagctatccatgggggaaagagaacaaaatgcttgctgatttctaccataaaataattaaaataagaaataatgaagatggtttaaaaaaagggaagttaagtatctttgaaactgatccaaacgtatttgcgtttgaaagaaaatatgaaaatgaaagcgtaatagtattagtaaatgtttcaagcaaagctaaattaattaaagaaattaacttaagtggagattatgtgaatttacttgatattagtgaaaagtataagtttgcaggaagtgatagcgttataactatctttccatatgatttgaaaatattgcgtaggatctagttcattgagtttgattatataataaaaaattgacaaatattttgatatatgcttatgtggaatttaatggaaaataaatgtataatatattgtatgcaaaactataaatataaattccaggggtaatcatattataaaataattattaaaaatataatatgcttctgcaagttcacttaaataaaaatgtaataataatcattttttttgaacataggagcatataatataaaatttatctaatgagaacaaacacatatgagaggagataatattatgggtaaaaatgaaattgtggcaatgatattggctggtggacaaggatcgaggttaggggtattaacaaaaaaattggctaaaccagcagtaccgtttggaggaaaatatagaattatagattttccattaagcaattgttcgaattcaggaatatatacagtaggagtattaacgcagtataaaccgctagaattaaatgcacatattggcataggagaagcatgggatttagacagggctcatggaggggtacatgtattgccaccatatcaagaagaaaaaggcggagagtggtataaaggtactgcaaatgcaatttatcaaaatatagaatttgttgatagatatgatccagaatatattttgattttatctggagatcatatatataagatggattatacaaagatgctagatttccataaagaaaaacaggcagaggcaactatagctgttattgaagtgccaatggatgaagcatctcgatttggaataatgaatacaagggaagatttatcaatatatgaattcgaagaaaaaccaaaaaacccaaaaaataatctagcatcaatgggaatatatattttcaattggaaaactctaaaaaaatatttgagagaggatgaatcggacaagacatcaaaaaatgacttcggaatgaatataattccaagtatgcttggtaatgggaataaaatggttgcctatccatttaaaggatattggaaagatgttggtactatagatagcctatgggaagcaaatatggatttgataagagaagataatgaacttgatttacatgatgaggaatggaagatatattcagtcaatccagtaaggccggcacaatatataggcgagaatgcaaaagtatctaattcattagttgttgaaggttgtgttgttaatggacaagtggaaagctcaatattatttcaaggagttcaaataggaaaaaactcagttgttcgagattcaataattatgacggatgctaaaataggtgataatgtagttattgaaaaagcaattgttggaagcggagcaatagttcgaaaagactgtaagatttctttaggtgatgaaatagctattattgcagcaaaagaagaagtaaaaatgggtacagttatagaaaataataaagcagtttagcgagatcactaagggggagaaagaaatgaaaaattgtattggtataatcaacttagatgaaaatgaaaacagaatgggtgaattagtagttaatagatctcttgcttcagttcctattgcagcaagatatagaattatagattttattttatcaaatatgactaactcaggaattaattgtataggaatattcacaaagaataagtcaaggtctctaatagaccatttaacaaatggaagaccatgggacttaaatagaaaaaaagatggattaaaagtttttaactttggaaatgacgagcctgtttatgatgatgtccataatttcgctgaaaacatacaatttttaacacatagtagaagagagtatgtattattagcaccaagctatatgatttgtaatatagattacaatgaagttttggaataccataagagtacaggtaaagatattacaatggtatataagaaggtaaacaatgcagatgaagcttttggtgattgtggcgtattaaactttgatgattcaggaagcgttataagtgtaggagaaaatatagggaaaagtccgaaggcaaatattaatatggagatgtatatattaaaaactgaattatttataaatattgtaaatgaatgtgtaagcagtggaatgtatcgaaaggtcaaagagtatattcataataatttaaatacactaacagcaagtgcttacgaattcaaaggacatttagattgtataaattccattaaggcattatatgatagcaatgtgggatttttaaatagaaaagtaaataaagaaatttttaatgatgaaagacctatatatacaaaaactaaagatgaagctccaactcactatgcagatacaagcagtgttataaactcaataatagcaaatggttgtagaatagaaggaacgattgaaaattgcataataggcagaagagtatatataggaaaaaatacaaagttaaaagattgtataataatgcaaaatagcagaattggtgacgatgcagtattggataatgtaattgcagataaaggtagcgagataagaagtggtgagacccttattggatcagttatgtatcctttggttataaagaaaaaaagtagtattactaagtaaagatatatagaagatactatttttagaaattgaatagttatattattataaaatattaattaggtaagtatcagaaaattagatttgtgattcattaagttagtattatctatattaggaaaattaaatgcagaatttgaacgatatagtgattaacaactaagaaataatgttagcaaagtataattttatgatgcttactttatttatatcaatacaactttaatatgtctattatgtgatagataaggtatgttaaaaactttatacattatggattactattttatttatggaactaatagaagtataaatttatagtataaacatgatatagtgacacagaactgttagtcttagagaaatttagaaagtaaatttaatctggaatttattataagtattaagccgtataatctcattgctaatttgtaataaggggataacagtatgcacatcacataatattttaacaaatatgttgacagcataacgggaacgtgttaaaataaataacgtcgctgagatatgtaaataacttaatgataaatcgcagatttgtatcttaaatatgattttaaagattttgaaaaaggctattgacataatataaaataagtgatatactaaataagtcgcttgagggtgacataaattaataactacaatgagaattgtaggaaagaaaattggtctttgaaaattgaacagaataacataaatacatttaagtaaaccagcaatttttatttgagtaagctaagattaaactttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtgccgcatggcatagcaattaaaggagtaatccgctatgagatggacccgcgtcgcattagctagttggtgaggcaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgctaaaccgtgaggtggagccaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgcaagcgaggcagcgacctaaggtagggtcagcgattggggtgaagtcgtaacaaggtagccgtaggagaacctgcggctggatcacctcctttctatggagaaatctagatcagcatgatgtctgactagtacagatacattattatgtatcaaaatataaaatacttgctcaaaggttacttaagtatttgttctgttcaattttgaaagactaagtctttcaatgttctttgaaaattgcacatagatttaatgtatataaaatacaacaaagccaagaataaatattctttgtgatatgactaataattaggtcaagctacaaagggcgcatggtgaatgccttggcatcaggagccgatgaaggacgcgataagctgcgataagcttcgggtagacgcacatagtcagagatccgaagatttccgaatgaggaaactcacatgggaaaccccatgtatcataaagtgaatacatagctttatgaaggtatacccagggaactgaaacatctaagtacctggaggaagagaaagaaaaatcgattttcttagtagcggcgagcgaaaaggaaagagcccaaaccagagatttatctctggggttgcggacagaacataacgagaaatcatagttaattgaacacaactggaaagttggaccacagtgggtaatagtcccgtaagtgaaaactatgataatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcagagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcggaaaatgtgagtagtggaggtagagcactgaataggctagggggcatagcgcttaccgaaccttatcaaactccgaatgccacatactatcagtccggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcacgtttaacgtgagcggtagaggagcgtcgtaatcgggctgaagtcgtaccgtaaggagcggtggactgattacgagtgagaatgttggcattagtagcgagatgtaggcgagaatcctacaggccgaatatctaaggtttcctgagtaaagtttgtcttctcagggttagtcgggacctaaggcgaggccgaaaggcgtagtcgatggacaattggttgatattccaataccactataatcgttattatcgatggtgtgacggagaaggataggatgtgctagctattggatgctagtctaagcgtttagggagttgggattggcaaatccgttccaacaattctgaggcgtgatggggaaggttctacggaaccgaagtatctgattccatgcttccaagaaaagcatctagagagagaagtagtgcccgtaccgcaaaccgacacaggtagatgaggagagaatcctaaggccgacggaagaattgcagttaaggaactaggcaaattgaccccgtaacttcgggagaaggggtgcctgagaaatcaggccgcagagaataggcacaagcaactgtttaacaaaaacacaggtctctgctaaagcgaaagctgatgtataggggctgacgcctgcccggtgctggaaggttaaggggaacacttagtggtaacgcgaaggtgtgaacttaagccccagtaaacggcggccgtaactataacggtcctaaggtagcgaaattccttgtcaggtaagttctgacccgcacgaatggcgtaatgacttgtgcactgtctcaactgcaaatccggcgaagttgtagtgcgagtgaagatgctcgctacccgcgattggacggaaagaccccgtagagctttactgtagcttagcattgaatttcggtattgtctgtacaggataggtgggagactgggaaactagggcgtcagccttggtggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgaagagtgtaaaggcagaagggagcctgactgcgacacctacaagtggagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtatggcaacatatttagctgactgatactaataggtcgagggcttgaccaatatagtcaagttgtaaatacattaaagaaactgtgtgcaattttgaaagaacaaagttttttcaaattgaagatctcgtgatgatggcatagaggtaacactccttcccattccgaacaggaaagttaaggtctatagcgccgatggtactgcatgggagactgtgtggcagagtaggacgttgcgaggtaagatttgcgtgattagctcagttggtagagcacctgactcttaatcagggtgtccagggttcgaatccctgatgacgcaccataacaaaggttgttaattttattaacaaccttttttgttttaaaataaattattaaagaagtaatttattttcagtattataaacatttaggaataaaagattggattaatttattaattagataaattttgaatacgaagactgattttatattcttagaagagagttaagatagtgtataatataatccataatatttaatcgttcatatatacgtaattataagtgaataaatgagtgtaaaataataataatatgagtaagaataagtttcttaaaaggagttaaatatgagtttaaaaaaaagtaaagtggctattataggaacaggattagtagggtctagtacagcctttagtctgatgactcaaggggtatgtgatgagatattaatgattgatataaatgaagaaaaggctctaggggaagtaatggatttaaatcattgtattgaatatttgaatagaaatataagaattgtcagggggaactatgagcaatgcggggatgtagatattgtggtaataacagctggtgcaccgcctaagcaagggcaaactagattagatacactagaattatcagctaaaatagtagaatccattgtaaggccaataatgaagagtggatttaaaggacactttattgttatttccaatccggttgatatgatagcatatcatgtttataagatatctgggctaccaaagagtcatattataggcactggtacttcagttgattcagcaagactaaaaaatttcattggggaactattaaatgtggatccgcgtagtgtgcaaggatattctatgggagaacacggagattcgcagatggtcccatggtctcatgttacagttggagggaagtcattctacgagatattaaaagacaataaagatagagtaggaaaagttgacttagataaactagtactagaaacagcgagagcaggttgggaagtgtacaatagaaaaggaacaacgtattatggtatagcaacagcagctgtaggagtcataaaagcgataataaatgatgaaaacaagataatgccagtatctacattattagatggcgagtatggagaaaaagatgttttttgtggagtacctgctgttttaaatgctgatggggttaaagaggtagtggaaattcatatgacaaaagaagagttgagcaagtttaaaagatctatagagttaataaaagaatataccaaaaaaataaaataagttttatttctgaataagtgttgacataatagataatactatgtataataatatcttgttgagacaagttttcgacaagatattataaaatagttatataaagattatttcataaatttgaagtaatagatgaagattgtatcaactattaattaaaatctcgtgatgatggcatagaggtaacactccttcccattccgaacaggaaagttaaggtctatagcgccgatggtactgcatgggagactgtgtggcagagtaggacgttgcgaggtaagatggttcactagctcagtcggtagagcacatgacttttaatcatggtgtcccgggttcgattcccgggtgagccaccaattactttattaaaagtaatcttattgaaaaacttgcttagtatttatataaataaaagagttttactgaaagtaaaactcttttttttatttacctttataaattttgaaacatatcatattacaaatttataaaatgaataacattaaataagtattcataggttttactaatctaatagataactgtttagaaggatttgaacttatgcgagatatccttttttataaataagaaaaactttcttaatgattgaatatcttccttaactgatgtatcttcattagatgcaaggtatccattgttaaacatagtaagggcaaagaataatattcctatattaatatataagtcttttatatcagcaatgaataaattacttattcctataaaatctaaactaccaccataaaaaatcttgtcaatcagcgaacatgtagcaccacagcatacaaaaataaagcacatatcggcccagaaatccttgtttcctttgtataaataatatctatatacttcgataaaaataaatatagcaaatatatttatagttattaaaataggaaaattaacggatgctccaaatctagcatttagccaagaaccttcagtattaattataggtcgaaaatataacaagctagatattataggaaaatcattattaaaccaaaagagttttattaatatctttattccttgatcaaatagaaaaagaaagaaaaatagaattacaagtgtattagacttaaatccacattcgtatttaattccgattatgtagctaaatagacctactagtgcaaataatataattagtatcatattaaataaaattgttctaagatcattaattcttccagtaataagctcgaataagacatatatagtccacatcaaaggaagaatacttatagttaacacttttttatttttcataagagtacctccaactgtaattgtattacgttatactaaagtgtaacatatagtaaaaaaaaattcactactgttaaatgaaccaaatttagtttaatatagagataacaggaacacatacataattaattaaagtattgtaagcattggtcagggtatatatttataaaaaaagagtaaggtataaaaagtatcatgagattatgagaaagaaggtataaatatgttaacaattttagcagtatcagattcgataggagaaactgcaaaccaagttgctgttgcagcggcaagtcaatttacagaaaaagtagatgttaaaagaattccatatgtaaaatctttagaagatgttgaagatgtaatgaatattgcaaatgagtgcgagagcgtgataattgtatctactataattactgttaatgtaagggagcatttgacacaaaaagcaatggaaaaaaatatatcggttatgaatgtattagggccaataataaatgtggcatcaactatattaaatacacatcctacatacaacccaggtgctatgaggcaaacagacgaagtatatttcaagagaatagaagccatggaatttgctatgcaatatgatgatagtaaagattataggggattaaagaatgccgatgtagtgttgatcggactttcaagaacttcaaaaacaccactttgtatgtatttagccaataagggggtaaaggcaataaacattcctttaatgcctgaagtgggagttccagatgaaatatatgaaattgatagaaaaaaagtatttggattaacaataaatccacttagattaattgaaataaggaaaagaaggttagataagtttcataggattacgtcagacattgaatatgcaggagatgcaagagtgttagaagaacttgattttgcagataaaataatgagaaaaataggatgtaagactatagatgttacagagagagctattgaagatactgctttaattattctagagaagatagggtataacaataaataagctattaataagcaactaattttggaaatgatataagttgatatataagataagttaaaaaaagcaagttttgtttaccaaaatatttgtaagcgaaatttgctttttttatatcaaatgcgctaagctgttgtacttaaacataatggaaataaaggaaagttagtaaaagctatatgttatataatataactattcctagtgtatcactaatagaattagagagaattttacgtgaattttagactataatgaatataaagtcatttaataggataatttaatataataagacaattatcatatatgttaatataataaacgtcgctgaagtacataaataacttcaattgaactaagaaaaacttttctgattgagttcaaaaaaattaaaaagttattgacagtatgtaaagcagatgatatactaaataagtcgcttgagggtgacataaattaatagctacaatgagaattgtaggaaagaaaattggtctttgaaaattgaacagaataagataaatacatttaagtaaaccagcaatttttatttgagtaagctaagattaaactttttattgagagtttgatcctggctcaggacgaacgctggcggcgtgcttaacacatgcaagtcgagcgatgaagctccttcgggagcggattagcggcggacgggtgagtaacacgtgggtaacctgcctcatagagtggaatagcctttcgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgctaaaccgcgaggtggagccaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgcaagcgaggcagcgacctaaggtagggtcagcgattggggtgaagtcgtaacaaggtagccgtaggagaacctgcggctggatcacctcctttctatggagaaatctagatcagcatgatgtctgactagtacagatacattattatgtatcaaaatataaaatacttgctcaaaggttacttaagtatttgttctgttcaattttgaaagactaagtctttcaatgttctttgaaaattgcacatagatttaatgtatataaaatacaacaaagccaagaataaatattctttgtgatatgactaataattaggtcaagctacaaagggcgcatggtgaatgccttggcatcaggagccgatgaaggacgcgataagctgcgataagcttcgggtagacgcacatagtcagagatccgaagatttccgaatgaggaaactcacatgggaaaccccatgtatcataaagtgaatacatagctttatgaaggtatacccagggaactgaaacatctaagtacctggaggaagagaaagaaaaatcgattttcttagtagcggcgagcgaaaaggaaagagcccaaaccagagatttatctctggggttgcggacagaacataacgagaaatcatagttaattgaacacaactggaaagttggaccacagtgggtaatagtcccgtaagtgaaaactatgataatcagttctgcaccagagtaccacgagacacgtgaaaccttgtgggaagcagggaggaccacctcccaaggctaaatactacctgatgaccgatagtgaagcagtaccgtgagggaaaggtgaaaagaaccccgggaggggagtgaaatagaacctgaaaccatgtgcctacaaccgatcagagcaccttatgtgtgtgatgatgtgctttttgtagaacgagccaacgagttacggtatgtagcgaggttaagtacttaaggtacggagccgaagggaaaccgagtcttaatagggcgactagttgcatgctgtagacccgaaaccgggtgacctatccatggccaggttgaagcgagggtaaaacctcgtggaggaccgaaccacgttgctgttgaaaaagcatgggatgagctgtggatagcggagaaattccaatcgaactcggatatagctggttctcctcgaaatagctttagggctagcgtcggaaaatgtgagtagtggaggtagagcactgaataggctagggggcatagcgcttaccgaaccttatcaaactccgaatgccacatactatcagtccggcagtcagactatgaaagataagttccatggtcaaaagggaaacagcccagatcgtcagctaaggtcccaaagtgtaagttaagtggaaaaggatgtgggatttctaagacaactaggatgttggcttagaagcagccactcattaaaagagtgcgtaatagctcactagtcaagagatcctgcgccgaaaatgtccggggctcaaacttaccaccgaagctacgggttcacgtttaacgtgagcggtagaggagcgtcgtaatcgggctgaagtcgtaccgtaaggagcggtggactgattacgagtgagaatgttggcattagtagcgagatgtaggcgagaatcctacaggccgaatatctaaggtttcctgagtaaagtttgtcttctcagggttagtcgggacctaaggcgaggccgaaaggcgtagtcgatggacaattggttgatattccaataccactataatcgttattatcgatggtgtgacggagaaggataggatgtgctagctattggatgctagtctaagcgtttagggagttgggattggcaaatccgttccaacaattctgaggcgtgatggggaaggttctacggaaccgaagtatctgattccatgcttccaagaaaagcatctagagagagaagtagtgcccgtaccgcaaaccgacacaggtagatgaggagagaatcctaaggccgacggaagaattgcagttaaggaactaggcaaattgaccccgtaacttcgggagaaggggtgcctgagaaatcaggccgcagagaataggcacaagcaactgtttaacaaaaacacaggtctctgctaaagcgaaagctgatgtataggggctgacgcctgcccggtgctggaaggttaaggggaacacttagcaagtttgcgaaggtgtgaacttaagccccagtaaacggcggccgtaactataacggtcctaaggtagcgaaattccttgtcaggtaagttctgacccgcacgaatggcgtaatgacttgtgcactgtctcaactgcaaatccggcgaagttgtagtgcgagtgaagatgctcgctacccgcgattggacggaaagaccccgtagagctttactgtagcttagcattgaatttcggtattgtctgtacaggataggtgggagactgggaaactagggcgtcagccttggtggagtcgttgttgggataccaccctgatagtattgaagttctaactggatgccatgaaactggtgacaggacattgttaggtgggcagtttgactggggcggtcgcctcctaaaatgtaacggaggcgcccaaaggttccctcagaacggtcggaaatcgttcgaagagtgtaaaggcagaagggagcctgactgcgacacctacaagtggagcagggacgaaagtcgggcttagtgatccggtggtacctcgtgggagggccatcgctcaacggataaaagctacctcggggataacaggctgatctcccccaagagttcacatcgacggggaggtttggcacctcgatgtcggctcgtcgcatcctggggctgaagtaggtcccaagggttgggctgttcgcccattaaagcggcacgcgagctgggttcagaacgtcgtgagacagttcggtccctatccgtcgcgggcgtaggaaatttgagaggagctgtccttagtacgagaggaccgggatggactgacctatggtgtaccagttgtttcgccagaagcatagctgggtagctaagtcgggaagggataaacgctgaaagcatctaagtgtgaagcccacctcaagatgagatttcccatagcataagctagtaagaccccttgaagactacaaggttgataggtcagaggtgtaagtatggtaacatatttagctgactgatactaataggtcgagggcttgaccaatatagtcaaattgtaaatacattaaagaaactgtgtgcaattttgaaagaacaaagttttttcaaattgaagatctcgtgatgatggcatagaggtaacactccttcccattccgaacaggaaagttaaggtctatagcgccgatggtactgcatgggagactgtgtggcagagtaggacgttgcgaggtaatcttgtagattacaagagttaagttaaagaaatttaacttacggatctttagctcagttggttagagcaaccggctcataaccggtaggtctagggttcgagtccctgaaggtccaccatgggggtatagctcagttgggagagcacctgccttgcacgcagggggtcaagagttcgaatctctttatctccaccattaaaaactatgaattttattcatagtttttttgttttattattataaatattgttgttaaataatatttattactggtatgagttatatggtgcagaaaatagtagaacaacagtataaaataggctaaaaatactaattgttaaagtatacaatgaatgaattataatatataatttatatgtaaaatatatgtaaaaatgtaatttgatatttttatttattgtataaaaattatattgcgaggggtaggattatggtaagaactattgtctgcaaaaaagatggatgtagcggtaatgaatttcatatatcaacagaagacaataaacttaaattagtatgtaaagactgtggaagtacttattattatgatgtgagttattatgaatttataatgttatcaaattgtgcagagtgtaataacgatacatttaaggtgtttaataatttagataaacaaggaatatatgctaagtgttctaagtgtggtgctccaccagaaaaaatatacattgatgatgaaggtgttcaagttacttatgaagcaaagttactacaagatataaagcagtttatgtatcaaattgatcaaagaatttgtagcttagagatgaaaatcgatggtttggaaaaagggcaagaattattagaagaatcacttgcttatataaatagatatatgtctgagtaatataatatctgtgaattttaaaattgtacttaaagaggatggaatatgaagaacaaaaggaaaattatttactggtttttattaatagtttggatgatagggatatttattatgtctaatcaacctgctcaaatatctgattctcaaagtgaaggcgtaataaatattctttctgctataggtatcaatatgaatggaatctttgggcagcttactaattttatagttagaaaatgtgcacattttcttgaatatatggtgttatcattactagcatttaatgtgtttaaattgtattttaacatcagaagagttatttttgtgacagtagtttttgtatttttttatgcttgttctgatgaaatacatcaattatttgttttaggaagagaaggtgcttttagagatgttataatagatacagttgggggtattacactaatattgattaatctatttagaatgtatgtagttgccaattttaatgaaggtaaataaaagataatttgaataatttagatatagtaatttaagattaaaaccaaattaatcaattgaattttaaaataatataaatcagttaattatattaaggtatgaaaataaggaataaaaagtaaataaaaattttgaaagctaagtatataatgcaaattaagcattgtgtacttagctttcattttctataacagaaattaaatatgtgttatgcaaacataaatatgagttagtgagaaacaaatatagatattgttttaattagagtaaacaaaattacaattactttaaaagtacttgttaaacctatttatgagatgaattaaattttattttaaataaatcatttactttaaatagaatataaacaagaataagtattaataatccatcaaaagtgaagttgaacaaaaataattgtttcgcggtatcagcctttccattgcctacaaaaggcattggaaattgaagtatacctataaatataacagtccaaagcaagaaaattttgttcttgatttcaggattagaactatttcgaatatatttatacagtgagcataacagaacaataagataaattaatcctataaaatataaatttctaggtaatattttttcccttatagatgaccaaagtgtgaaacgatggaaatccctaactggggttgaactatcagtttttgagtacttacctagtccagtactagtataaaatgctttacttgcggtatatttcatgccatttagtaagcgagtagggtgagtcaaatagaattttgcaagtttaaagttatttattttgctgtagaatttttcatcagttatttctgaaccaggaatatattttacatattcatcagaatctaaataagcatgtttcccagcctcagctgataaatcaggatctaagcctaaatctatcaagtcctgctctggagtagtagattcgtttagtactccataaaagactgagttatactgggtatctttacttaagttgttgctattcatattgatgagaataggatagcttatcaataagcatgtaataatatataaaatagctaaactgattttatttaaattatgtctattatccaataatattttacatataagaattataataataggtaaggaagtaataacctgtaatttagaacctaaaaataaaaatgctgaaaataatatataaagtattttcgacattaatttttccgttccctttactacgtatttgtattgaatatagttaagaatggatgcaacaagcaatgatagtgtagttatcatcattggttctccatataggctattaaaccaaattaaataattgccatcaaagaaaatgaatgcggttattagtacaagcatcatagatttaatattattttttatattcaaagattttaatattatgataaatgaaagaatatatataatactatagatgacagctaaatattgagttttaaatatattatgatcaagtgatttgcatatataattaacaagtattattagatagctcaaactacaattccagatgcttttagaatcagtatcgtttaaaggggtaatcttgtaatcagtcacaataaagtcgtaatatcctacagagttaggattgttcgtatctgagtctaataatgacagaccagatacattcataattctatagaaatcaccttgatcagcaacacccacttggggttttataaataagactccgatagttatagaaattgcaagtaaagcaaaccaaaacatatggaagtttcttaaattcttttttgctttcattaaattttcctccacaaagatagatttaaagtaataaacatgattctaaagatattaacagataaaattataatgttttttggttaatactacaagaaaacatcaaattaatttaaaggactacttccaaaataggataaatataaattttcagaaaattaagaaaataaggaggatttaacgaatagaaatagaaatataacatatagcattattaagtgaaaggcaggtgggagccaatctctagggtagattaagggtttggcagcattatgaaagattatagtattaaaaatttaagaaatgtaggattaatggggcataatggaactggaaagacttccttagcggaaagccttctgtattattcaaaaattacagatagattagggaatattgaagatggaactacggttttagattttgatactgaagaaaagaagagacaattttctattgctctttcagtagcaccaattgaattagataatgttaaaataaatcttatagatattcctggatatgcagactttcaaggtgaatgtatagaaggaatgagagccgtggatgtaggtatgatagttgtaagcggagtttcaggagtcaaggcgggaactgaaagagcctgggaatattgtaacaaaattaaattgcctagaacattttttataaataaattagatagagagaactcggattttaataaagtattagcatctcttaaagaaaaatttggtatcagcgtggtgcctattcagtatcctataggagaagaagacaattttaaaggagtaataaatataatatccaaacaagcaagagtatacgatgtaaagactaaggaaataaaaatattggatatacccgaagagctccaggatgaagttgaaaattgtaagaagatgattatggaagctgtagctgagactgatgaagtattgcttgataaatattttagtgaaggcgaattgagtgatgaggaaatatataagggccttataagtggatgtgctagtggagatattgcccctgttatgtgtggaagtgctacaaaagttattggaatggattctttaattgatgatattgtagaatgttttccatcgccagaatatgctatcccacaaaaagctgtagacgttttaaaagatgaagaggtttttgttaatcttaatcaagataagcctttttctgcattagtatttaaaactattgcagatccatttgtaggtaggatatcattttttagagttattacaggtgaagcgaaagatgatatgacagtattaaatgttaataaagataagaatgaaaaattatctcatatatgttttattagaggtaagacacaaataccagctaaaagaataatagctggtgatataggtgctatttctaagttacagtatacaaatacaggcgatactttagctagttctgattttaaagtaatatatgacaaaatgaattttcctaagacagttttctcaatggctgtaatccctcaagctaaaggtgatgaggaaaagatatctcaagccttggctaagttaaaagatgaagatcctgtttttcaaattgatagagatgtagaaaacgcagaaattgtaatctcaggactaggagaaacacatattaatgtaatcgcaagtaaaataaaaagtaaatttggtgtagacacagtattaagtttaccaaaggtaccttataaagaaacgataaggggattttcagatgtacaaggaaaacataaaaagcagtctggtggacatggccagtatggagatgtggtaattaaatttgaacgtagaacagatggagaggaagaattagaatttattgataacgttgttggtggtgcagtcccaagaaactttattccagcagtagaaaaaggattaagagagtgtataacccatggagttttagcaggatgcccagttataggtcttaaagcgactcttcatgatggatcatatcactctgtagattcttctgaaatggcttttaaggttgcagcttctatagcttataaaaagggattagagcaagctaaacctattctattggaacctataatgaaagtagaagttatattaccaaatgaatatatgggtgatgtaatagctgatataaataaaaagaggggaagagtaatcggaatggaaccagaaggggacaagcaaagagttatatcagaaattccgcttgccgaaattagaaaatatgctactgagttgagatctttaactcaaggaagaggagtatttacaaaagaatttgtaagatatgaagaagttccagagatagaggtagcgaaagccatagagagcattaatgaattaagaaaataagattacggaaatttatagctaaaatttacggaataggaataaagagtactctagtgtaggtattacataaagggtactttttatttattggcttaataaagagaaataaaataaaatttactataattaaggaataaggtaaattttacattaatatatataggataaaatcatgtgcagaaagacataatattttagtaatagtatattttatacaatttgaacaaggaggcctgtacaatgtcagattatagcatggatattaatggaaatatagagttgagtgattatagtaatatatttgactatttaaatataatagacaaagatgataattttgtaataaggatagatagaaataataaggatgatatagaattaattaattctatgcttcaagataataaattcaatatcaattatacacaatatgacgattttgggaactattacataagcgccaataaaggatcttgaaaaaatattatttaaaatacaggttttattggaatagcataatatagtataatatgtattagcaaattgttttttattggtatattaaataaaataaaggagagttatattatgcaaaaatatgttataggagtagatttaggaggaactaagataagtactgcattatctaatttaaatggagaagtgttatgtcaaacaacagttcctacaaatgcaagcgagggagaaattccagtattaaatagaattatagaatctgttgaaaaagtaattaaagatggatcagtaacttataaagatataaaaggaattggtatcggttcccctggacctttagatgctgaaaaaggaaccataatctatacaccaaaccttccatttaagaattttaatttagtggaacctttaaataaaaagtttgaagttcctgtatttttagataatgatgcaaacgttgcagctatcggtgaatatatgtttggtgcaggaaaaggcgctaaagatgtagtattcttcacagtaagcactggcgtaggcggaggcgctgtcttaaatggaaaggtatatagaggacacacttcaaatgccttagaaataggacatatgacagtggcaccagatggaccaagatgtaattgtggaaatatagggtgtgtagaagcaacatcatcaggaactgcaattgcaaaaagaggacaggaagcattagctagcaaagttgagacttcattaagaaagtatgatactattacttcatatgaggtgtttacagaagcggctgcaggagatccagtttgcgtagatataattaataatgcactgaattatttaggaatagctatagctaatgcagtatctatatttgatccagaaattataataataggtggtggtgtatcaaaagctggagagattgtttttgatacagtaagaaaagttgttgataagagatgttttaaatccatggcagaatcagttaagattgttccagcaggattaggtacagatgcaggggtaattggtgcggtagcattagcattgcttgaaacagaagataagtaatataaagaatgaagcaagtaaagtagtgtagatttttagattaaccctagagctttgaaacatttagaatagacttttataatagaattgcagatagatgtgaataaagattaaaaatttcacataaaattagaacagaaagctctctttgcaatgaattttttcttctcatacatattactaagtttattctaggttaattacttaactaatgagacttttattttgatatttaaagtatttacctataatagattgggatgaaaaaaatttttatataagctatctctagatatacttagagatagcatattataaaagaatatattttatatgaaacctattcaatagattgttggataggtttcaatctttaattataatataaatagagattattgtaattaataatggtttagtagtataatttctaattaagaatattattgtagacttgcaaattaaataagaagaaggtaataagatgaaagcagagattatagccataggaacagagattttattaggcgatataattaattcaaatgcccaatatttagctcaggaattagcagcccttggaatagatatgtattatcagcaagtagtaggagataatgaaataagaattatgcatgcatttgatgaggcatatagcagaagtgacatcataataactacaggaggacttggacctacagatgatgatattacaaaagaagttgcagctaaatattttaataaagaattgattcaggatgaaaattcgattaaaaaaataaaagattattttaaatttagagaaagagtaatgactaaaaataatttaaagcaaggattaattccagaaggagcaactgttataaagaataataatggaacagcaccaggagttataatagaagatgataataagataatgatcattttacctgggccaccaaaggaaatgaaaccaatgtttgaagaatcggttaaaccatatcttcaagagaaatcagattcaatattggtttcaagagttgttaagatacttggaataggggaaagcgctgttgcagaagagattaaggatttaatagatgctcaaactaatcctacaattgcgccttatgcaaaagatgtaggagtaatgcttcgtataactgcaaaggctgaaactaaagatgaagcactaaaattgatagaaccaatcgaggaagaaattaagaacagacttggggataatgtttatgcaactgaggatattaacatagaagaagttgtagctaggcttttaatagagaagaaactaacaatatctacggcagaatcatgtactggtggcatgatagcaagctatcttattaattatccaggtatatcggaagtttttttagaaggcgctgtaacatattccaatgaggctaaacataatagactaggcgttaataatgatattttaaacaaatatggggccgtaagtgaagaaaccgcaagagaaatggcaattggtattgcaaagacagctaatactgatgttagcattgtaacaacaggaattgcaggaccagaaggtggtactttagaaaaacctgttggattggtttttataggtgtgtatgttcaaggaaaggtaacaatacaaaaatgtttgtttaagggagatagaaacaaagtaaggcttcaggctacaattacaggattagatatgctaagaagaattcttattaaataaattatgcaaaataaaaatgccataatatatttcaaacgaagtaatatattatggctttacaaattgtatataaataaaaatgggggagaggcgattaaatattgaagttaaatacttcattattatttattgccaaattaaatttatttatacataatttagataaaaaatttataattcttttatagcctcgcttaatgttttcccgaaagaatcgttaataaccaaattagctttggaatcagcagaggtagaacttttatttattaacacaagattctttcctctaaaataattgataagtccggcagcaggataaacaacaagtgaagttccacctataataagagtatctgcattagaaattgcatttatagattctctaattactttatcgtctagcccctcttcataaagaactacatcgggcttaacagttccaccacatttagtgcaagtaggaacttctttagattgtaggataaaattcacatcataggattcgtgacatttaacgcaataatttcgatggatagatccatgaagttcaaatacatttttgcttccagccatttgatgaagtccatctatattttgtgtcacgatagcttttaattttcccagttcttcaagtttagctaatgctaagtggccggcattcggtttagcttctggatatataagttttgctttgtaaaatttaaaaaattcttcaggatatttaatataaaaagtatgtgatactaactgctcaggagtcaatgtagcgtttaatttctcgctaaataggccatttgagcttctaaagtcaggtatattagattccgtactgataccagctccgccgaaaaagactatattattactattctttaatatttctgataacttttcaatgctcatagaaaaacctccaaattagaatttattttaagtattaaaaacacattatcatgtatatttaattattgcacaattgattagaaaaataaaatataaaccctgatgaattaaacattttaaaatatttataataaaaaaataaaaaatgtgttgacataatataaataactcgatataatactacttgtatctggtgatgacggcgtagaggtaacactccttcccattccgaacaggaaagttaaggtctacagcgctgatggtactgcatgggagactgtgtggaagagtaagacgttgccaggtaatatggctcgatagctcagtcggtagagcagaggactgaaaatcctcgtgtcactggttcgattccagttcgagccaccaaaaaagcactaacataagttagtgctttttctatatctttagaaaattataattcagtaaaatctgtatacaattttttgaatagtttaattaacttaagttactatttcaagggaataaaaaatacattatattcgttaaaaagataacatttaaattatatttctaaatgttatctttttttatattaactatttgtaaaaaagttatataggaattccttaaacagtacattgatctatatatattgagtagataccgcagttagggcatacagtcacactaactatatagctatcatcaatttttcctaaaccaaaaagtttattaaaagatgtattcttatattcattacagatagtatttattacatattcattatcttttgtatatatgtaaaagtggtactctaagtaacgataagatttatttatttgctcttgagtattacatgtacatttatcaccataatattcagttgaaaaacttatttcttctccttcatttagagcattcaatattatatctaaggaaagacctgtaatctcattttccccttcaaaaaatatcccatcgcaattattctctgttagtacgtattctttattctcataaacaaatttataatccacaaaacaacctcctcaaaattagcgtataatcaattatacaccagcatatgcacaatgtttagcaaaactatatttaaacatttaatttataatagaaaggcttaatttaaatgtaagcattggaaaagtaaattaaataattatatattttcgatttgccagtcaattggttcttgatttgtagaaattagaaaattgtttgtttttgaaaaaggtttacttccgaagaagcctcttgatgcagataatggactaggatgaacggattttattataagatgcttaggattagtaataaagtcagtctttgaaatagcattattaccccaaagtatgaatactataggtgtttcctttttatttagcactttaataacctcatttgtgaattcttcccatcccttatttttgtgggaattagcttctccagctctaactgtaagtaccgtatttagcaataagactccttgatcagcccactttctcaaatagccattgtttggaatatagcaacctagatcagtatgtagttccttatagatattaattaaagatggtggagtttttacacctggattaacagaaaaactcaatccatgcgcttggccaggtccatgataaggatcttgacctaatataacaactttaactttattataaggtgtaaaatgtaaggcgttaaagagatcatacatattaggataaatggtcttagagttatattcatttattaaaaattttcttagattaatataataatctttttggaattcagactgcaaataatttttccaatcattttttaatatatcggacattaaatcacccctaaattagtataacattttatggtggttttatgtatactatgtatttttgattaaaaatctaaaatttatttagttatattattgttagaagtagtagatactgttaaaatgaagtgtatataacaaactgttaaaaataatataaaatgattataaaggagaattcacatggaaaataaagtgttagctgttgcagcaggatatgaaataacagaaaaagatttaaatgcaataattagtagatatccacaagagcaaagaggagctttacaaagcgaagaaaagaagaaacaattggtagaacaattgatttcatttgaattaatgaataagtttggaaaagaaatacaattagataagactcaagaatacaaagacgccatggaaaatatatcaaaggaagttataacttcaatggcaataaataaagtattgagtgatgtaacaataacagatgaagaagtaaagaaatactatgaagataataaagaagcttttggtcagcctgcaacagtttcagctagacatattctagtagaaactgaagaggaagcaaataaggcaagagaagaaatcttaagcggcaagatttcattcggagatgctgcaatgaaatattcaacatgcccatctaatcaacaaggtggaaatttaggtgaattctcaaaaggtatgatggttccagaatttgaagaagctgcttttacatcagaaataggaaaggttactgaaccggttaaaactcaatttgggtatcatttagtgttagtagatgcaaaaaatgaagcctcaatcaaaagttttgaagaagttaaagacagtgtattagataatttaattaaagaaaatcaacataaaaaatatgatcaaatattgaaggaattagaagctaaatacggagttgaaagaaaataaaaatttctatttaatagcaatatagtttcaaaaataaaggtaatgatggatacattacctttatttttttattttaaagttcatatgttattattttggaatataatacaatattcaaatatgattttatgttataaaaatgtattcagatatccctacgttacagatttatatactaacagcatgagaaaaagcttgtcttaaatttgcattgtagaatgttgaattatttttagtaatctaattattcgtatgtaggcgataaaacaaatatttataataactaatatctataaaagctcagtaaaggaaaaaatatatttatcacaatacttaagaatttcggatataggttctaaacataaatcatcttttattccgatcaccctcatatttgctttttttgcacttttcatagcagggagtatatcctcaaatactaaacagtattcaggtttaatatttaacttttttgctgctaataaatatatgtcaggacaatcttttccttttgcgacttcatcagtaatagtgattgaatcaaaatagtcataaaccccattgttttttaaacaagcctcaagcagtgggatagaattgctagtcgctaatgcaatttttattttattatcttttaaatattttaaaaaagtttttacacctgatttgagttttacattattagcgtaatgatgaaatgctgcatgatgccaatcactaagtatttcatctactgaatcttcaattttaaatctatttttaaaatatactgctgtctgataaaaacttaagtgttcaatatcgttttttaagtcattaggtacagcatgtcctttctttttaagataatctatgtcgatctgagaccatacccacatggaatctacaatagttccatctaaatcaaaaattacaccttttatattacttagcattttacacctccaaataattgttatttatataaacgaataaatattgatatagcttagtgctaaacttaatcttctattggtgtgccttagtgtcaataaatattataattgaagcattagatacgaataagaattagaagaattagtaataagatatatcttatagattaataaattactaaataaaaaaacttaaggatcaatccttaagttatagtagtctaataatatatttggtcggggtgacagggattgaacctgcgacctcatggtcccaaaccacgcgcgctcccatctgcgccacaccccggttatacattaattatatattcaagtaaatcttatgtcaaggactttagaagatgtaattaatacagaaaaaagttaattatagtcattagaataaataattttgtgatgagggaggctggaattgttaagttaagtttattgatgaaaatttatatatataagctataataagaatcacaaagaataagctagaaaaagtggggaatacggacgatatttagataatagtaggataaactaaattctcgctatatatatgaattgttcattcttatccaaggtgttataattatgtagtaatatagattaatggaggagggaaggtttaaaaccgatatttaatgaggagtagaattctagctattatgttagcaaccgtaatcgttgtaggtagctcgataccagcgtttgcgacgccagataatcaacagttgagtgattcaagacagaaatatgcagaaattgaaagcaagataacagatattcagaataaaattgatgatttaaatatgcagatagagccgctacaattaacagtagataagaataaaaaagaaataacaactatcaataaagttattgatagtagtacaaaagacattgaacaatataagaaagagattaatacattagatttagctttaggacaaagagttaaagctatgtacatgtcaggtgatttagaatttggttacttgaattttatacttgaatcagaatcaacaagtgatttcttttctagagcagaggcagttagtaaaattataggaaaagacaaatctgccatagaagatgttacaagtaaaaaggaagaattaaataacaaaataaaatccttagaagataagaaagatgaaatagataaacttaataaagaaatacaagttagcttaagtgaactcgatggaaagaaaaaagaagcagaaactttatcaagtcaagctaaggatgaaaaaagtaaatttgactcacaatacttatcacaattagaaagagaacttgtaaaatctcaatttgatgttataggtaactctaatagttcagctactgatcttcaaggagcaattaatcaattaagaaatattagagataatcaaattaagagtgagattgttacttcagagataaatgataaaattgaaaaggctaaaacaatggtagcagataaaaaagcagctgaagtaaaagtggcaacgccaagtagaggcggaggcggaagagtagctgtaccatcagcaggaaatgctcaatctattctaaatgaggcatatgcacagttaggaaagccttatgtatggggtgcaactggagatgcaagttttgactgttcaggatttactcaatatgtttatgagcatgctgcaggagtagatataacaagaacaacttattctcaaattggagttggacaaccagttagccaagatcagcttcaacctggagatttggtatttactcatccaggtcacgttgggatatatgttggtaatggccaaatgattaacgcacctcaaacaggtgatgtggttaaagttgcgccagtttatagtttttatgctgcaagaagagttcttaagtagttaacataagaaattagttgttaatatctgatttcaaattattgtccttctgtaaaagatcagaaggactttttttattttacttgtatgatataatgtggaatatatactttagagattaggtatatacaaatattgatattagatattttaaagtagaatattgtaaagttaagtagaggaagaataatatgaataataaattgcaatatgtgagagatgatgagacagtagatgatttgcaacttaagggattaaatttaattcaaaagaaggagggatttaaatttggtatagatgctgttttattatctgattttgcttatataaaaaacaaacataaggtgatggatttatgtacaggaactggaataattccatttttgatatatggcaaatataagcctgagcgtgtatatggattagaaattcaagaagatatggtagatatggctaaaaggagcgtaaaattaaatgagcttgaaggaaatgtatgttttataaatgaagatttaaaaaacatagattatctaaagacacttgataagtttgatgcggtgacagtaaatccaccttataaactaaacaattcaggaattataaatccaaatgataagcttgctatagctaggcatgaaatactatgtaatttagaagatgtgatttcggcagcaagaattttattaaaggataatggaagactctttatgatacatagacctgaaagattagcggatatttttgttttaatgagaaaatataaaatagaaccgaaaagagtaaaaatgattcatcctaaggtaggaaaagctcctaatattgtattggttgaaggacaaagagatgggggagcctatttgaagtgggaagcaccattgtatgtctatgatgaagatggaaaatatactaaagaaatagattcaatatattggaggtcatgatatggaaaatggaaagttgtatttagtaccaactcctattggaaacttaaaagatataacattgagggctctagaaactttaagaaatgttgatattatagcggctgaagatacaagacaaacgttgaaattattaaatcattttgagataaaaaaaccattaataagttatcacaaatttaatgagcaaataaaaagtgataaaattatagatttactaatggaaggtaataatgttgctttagtttcagatgctggaacacctggaatatcagatccaggaagtgttattgttggacgttgcatagaaaaaaagataaatttcgaagtacttccaggagcgacagctataactacggcattagtttattctggattagacacaactaaatttttattcaggggtttcttaccaagagaaaataaagaacgtaagatagtcacaaatgacttattgcaaagtcaggaaactattatcttttacgaagcaccgcatagactgatagatacgcttgaattcttattagatacgttcggagatagaaaaattgctgtatgtagagaattaactaagatttatcaagaaatatatagggggacgttaaaagaggctgctcaatattttctagagaataaaccaagaggagaatttgttcttgttctagaaggaaaaagacttgaagagataaaggaagagcaaagggaagagtggattcatttatctattgaagagcatatagttaaatatattaatggtggtgcgagtaagaaagaggcaataaagcttgtagccaaggaaagagaattacctaaaagtgaagtatataaattctcaactaatatataattaagttaagaaaatagactatctcaaattaactcttgagatagtctattatttattgactatataattaattatataataggaaattagaatacatcaaatactatctgtttgttttaatttcgtctaaacatttagtacagatattcttacctttatagttaattacgtctcttgcatctccacagaagatacaagctggttcgtatttctttaagattatttgctctccgtctacataaatttctaatgcatctttttcagcaatatctaatgttcttctaagttctataggaataactattcttcctaattcatctactcttctaactacacctgttgatttcataaaaaattcctcctaattccatgattcgacattctactatgatatattaccaagtatgtaatataaagtcaatgtatatttttaaatatttataagaaattacaaatttcaactttaataaacatcttatataaaatatactaccatattttagaaaagtcaagagggtttatttgtaaaattatcatattaatccaaattaataaatttgaggaatctagatgtaccaatggttagagaaatgtatatgaattatattcatgattatataatagtaaatttacaaataaagtaatataaggcatatgtccgctttttttgtagaaatgcaaatactataaataataatgtcgattgattacataaattagatattttttatcaatactatatttaaaaaaaattagatatgtcgtataatactattattatactaagagtataaactagtagaaaaatttttatattacaatgtttataataacttgtaacaagttcatgattactatataatatataatatagattgagaaagaataggtgcatgataatggcaggaaaatttgattcagattatataaaagaattggctaaagaaatgtctaaaagtacttccgtttcatatgaagatattcctaaatatgatttgtttttatcccaagtaatcgattatttgaacgataagtttgttgatgagaagtttactaacaatatagttcaaaattatactaaaagcgaagttataactaagccggaagatggaaaaaaaagaggatatacaaaaatgcatttagtacaattagtactgcttagccatatgaggcccttattaacgacggaagaaataaagaaagtttttcggcttgcatttaatgaaatcaatgacagaagcgatgatatactgtcatgggaagagacatataaaactttcacacaaatacaaaaggaaagtttggataactatttagatacgtttatatcaaatgatgataaattagaagatataataaagaattttgacttgaaagataatgataaggaaagaattaaaattttcctattagttctttctttaatagcagaagcaagtgttattaaaaagttagttcaaaaaatagttaaagagtatgaagaagaataaattatatgagataaaatatttacaatagcaataaactaaaaaacacttacttaattagaacttgaattttgttaggctaattaagtaagtgttttatgactatgtttatgatttaatattgaaaatgtgattttaactatagtgaggaattaatttatggataaaattcttatacgagagtctgtgagaaatttagtagaattttgcttgaaaaaaggtgatatagataataggttttctggaagtgctagggcagtagagggagtaagagcacatcaaaagcttcaggaagataacggaagggtttatgagaactatgaaaaggaagtatatttaactcatgaattcgagacgaataaaagcttgatctatattgaaggaagagcagatggaattataacagaaaaagataaagttataattgaagaaataaaatcaacttataagaattttgcatacattgatgatttgaatgaggtccattgggctcaggcaaaggtgtatgcttttatttatggaaatcaaaataatcttgaagaaatttatgtacgattatcctacatgcagttagaaacgaatgaggttaagagttttgaaaaaaaatttactataggagaattagaagaatttatatctgatttattaagagaatatgagagatttagtgttctaatatttaaatggaaaaacattagagatgaaactataaaagtactaaattttccttttgaaaaatacagagaaggtcaaaggaaacttattaatgtttcatatcaaactataaaagaggaagaaatattatttgttcaggcaccgacaggcataggaaaaactatatcaaccatattcccagctgtaaaggctataagcgaaggaatcggagaaaaaattatatatttgacggcaaagacgataaatagggaagttgctgaagaaacttttgaaagattgcgtcaagaaggcttgaaatttaggactatcacaattacggcaaaagagaaaacatgtattaatgatgattttgattgcaatccagagaagtgcatatatgccaaagactattatggtaaagtaaaaaaagtaattacaaatgttatcgaaagggaagaaagaatttccacggaaatattgaaggaatatgccgaaaaatatcaggtatgcccatttgagctatctttagatataagtacttattgtgatggaattataggtgattataattacatctttgatccaagagtatctttgagtagagttctagaaagcaaaggaaatatagttttggtggatgaagcacataatttaattgatagatcaagaaatatgtattccgcatccttatataaaagtcaaattctaaattgcaaaaagataactaagggtaaattaaataaactacattctttattgggaaagattaatgattatttcattaatttaagaaatgaatgcgaccatagagaagtgaaatcattttatgaagaggaacatcctaaggaattgagtaagtatttgcagttatacttaaaagaaagtgaagaagtgctagtaagaggaaatagatttgatggttatgaagatatattgaaattatattttgatatgaatgcttttacttctacgacacagctctatgatgaaaattataggacttgtatagaaaaggattctcaagaaatcaagttgactttatattgtgtaaatccagctaagaatttaagagaatatttagggaaatgctactcagtaatatttttttctgcaactatatcaccaataaaatactatgtaaatatgctgggcggagatgataatacatataggctaaagcttccatctcctttcaataaagaaaacttaaaagttcatattagtcctattaatattagatattcatatagaaaaaggaccttatcatcagtgaaagataaaatttgtggctttataaagcagcaaattggaaactacatgattttttcaccatcatatgcatatatggaagagttatatagccatatggaggagtcgaagctagaagaatttaatcttatgaaacagaaacctaatatgacggaggaagaaaaaagtgaatttttaagaagatttaagaatagcaataatttattaatgttttgtgtgcttggagggatgttttcagaaggaatagatttgcctggtgatcagttaattggaagcataataattggagtaggatatcctatggtagatatgacaaatgaagttataaaggatttttataaagaagatggttatgactatgcgtatgtatttccaggaataaataaaattcagcaggctgtaggaagagttataagaactgagacggacaaaggaagagttctgcttattgatgatagatatataaataataaatatagtgttcttttaccaaatgagtggtatcctataaataaatattaaattatctatagctgtatgaaataagctactagattgtattgtgcattgtgaattaaaaataagtatgttaaaatattcatggtagttttatgaaatagtatatctacatataattttagtatttacactacaattaaaaaaatatttagttattgatatcgtcagtcagaagtttgaatcggagatatattggtgatgattaataacatattaaagtagaattaaggagcgaggataatgaatattccattaattgatttaaaagctcaatataagtctattgctgaagatttagatagagtaactaaagaagtgctttcttctgcgaattatattatgggcaagaatgtaattgaatttgagagagaatttgcagaatatataggagttaaacatgcgatatcagtagcgaatggaactgatgcattggttattgcattaaaatctttaggaatagggaatggagatgaagtaataacttcgacatttacttattttgcttcagctgaagctatttcagcagtaggtgcaacgcctgtttttgttgatgttgaaaaggaaacatttaatatagatccaactaaaatagaagaaaaaattacaaataaaacaaaagctattataccagttcatatctttggacaatgtgctaagatggatgaaataaatgaaatagctaagaagcacaatttaaagatcgtagaggatgctgctcaagcatcaggatctagatataaaggaaagatggcgggaactttaggtgatgcagcatgcttctcattctttccaactaagaatctttcatgtgctggcgatggcggcatgatagtgacaaatgatgataatatagcgataatagcaaaagctttaagaacacatggaagtggagaaactggacaaaaagcttataatttgctaaataatataaatgatgagatagagacgtctaaagatggtgacgatactgtatataatgctttaaaatactataattatttaatcgggttcaactctaggttagatgctattcaagcagcaattctaagagtaaaattaccacatttagatgattggaatagtagaagaagagaagtagcgcaaatatataatgaaaaattaaaaggttctaatgtagctgtacctactgttgataaagaaaatgaaactatatatcatcaatatgtgttacaatgcgaaaatagagaagatatgataaataaacttaaagaaaatggtatagcaactggagtttattatccagtcccactacatttacaaaaagtatataaagatctaggatataaagaaggggatatgccggttgcagaatatttatcacatagaacatttgcaataccagtttatccagaattaacagaaaatgaaataaattatatagttgaaaatataaaggcataatattaatattgtgatatgcaaattcctatatattttgaacttgaggtttacttaaggaaaatattgataagtgcgagggttaattatggataagaattattttgtacatgaatcaagttacattgataacgacgtagtgataggtgacggaacgaagatttggcacttctctcatataatgagtaattctgtaattggagaaaagtgtaatataggtcaaaacgttgtaatatcgcctggtgtaaaaattggagatggagtaaagatacaaaataatgtgtctgtatatacaggagttatttgcgaagattatgtattcttaggaccgtcttgtgtgtttactaatgtagtaaatccaagaagctttattgaaagaaaaagcgagtataaagaaactataattggaaaaggggcttctataggtgctaatgtaacaattgtgtgcggtcataatatagggaaatatgcattagtaggtgctggagcagtagttactaaacacatacctgattatgccttagtagtaggcaatccggcaagtatcataggatatgtatgtgaatgtggagaaaagttgaactttaaagatgagcatgcaacttgtaaagcttgtgggaaaaagtatagcaaagataaagaaaaagtagaatgtatagattagaaaaacagatttttatttattaacatttcattgtataatttgttaataaaactttttagtaaattatgttctgtggataaaattttaggccgtaaattacaggaggtataagatgtcattattaaaacaacaattattagataaaataaataataaaactgcaaaagttggtgtggttggtcttggatatgttggattaccattagctgtggaaaaggctaatgctggttatcaaactattggatttgatgttcaagatcaaaaggtaaatatggttaatgaaggaaagaactatattggggatgtagtggatgaaaatttaaagaagatagtagaagaaaatactttaagagctactactgactttagttttgttaaagatgtagacactatttgtatttgcgttcctacaccattagatttatataagcaaccagatttatcatatgttgtagattcaacaaaaagtgttgcacaatatctacataaaggtatgcttgttattcttgaaagtactacatatccaggaacaactgaagaggttcttaagccaatactagaagaaagtggacttaaatgtggagaagactttttcttagccttttcaccagaaagagttgatccaggtaataaggactttaatactaaaaatactcctaaagttgttgggggtgtacacctgattgtacagaagttgcagcagcattatatagaaatatattagagggagatatccatactgtatcatctccagccgtagctgaaatggaaaaaatattggaaaatacatttagaaatataaatattggattagctaacgaaatggctattttatgtaatagaatgggaatagatgtatgggaagttatagatgcagctaagaccaagccatacggatttatgccgttttatccaggtccaggcttaggtggacattgtattcctcttgatccattttacttagagtggaaagcaaaagaatatgattatcatacaagattaatagaaacttcaggagaaataaatgattctatgcctgaatttgtattagataatgtaatgaagattttgaataagaataaaaaggcattaaatggtgcgaaagttcttttattaggagttgcatataagaatgatatcgatgattatagagaatctccagcattcaaggtaatagagctattagaaaagaatggcgctgacttaatggtaaatgatccgtattgtccgatttctaaatataagggtaaggtttataattctgttgattggaaagaggttatagacgagtctgatatagtaattataactacaaatcatagttgttacgattacgaatcaattgtgtctagagctaaagttatttatgatactagaaatgcaactaaaaatgttgttaataatagagagaaaatttataaattataagtttttcaaggtgtatataagctgattctatgcaagaatggtatattaattccaatgagttactattagttagaatatactgtttataaaaagagcacctccataattttatggaggtgttcttttatttacatttattaatagtacatataatttgtgaaaagcgaataaaataagtactgcataaaataaatagatatttaattaatataaatagaaattggtgattaaatgaaatatataaaattaagtagcaaagttaatttaattatacatcttatagtaaaaattaagagggacgatgtgtttgcactagcatctcagttagcatattatttaatattatcatttttcccatttatgttatttttgatgactttagctggatttagcagcataagctctaaacaaatactgggacaattaaatgttatgcttcctaggagtgtattggaattaactcagtcaactgttgtagagatatttgacaatcaatatactggattgttaggaatatctatattgttaacgctatggacagcgtcatctgcatttaaggctataataaaaagcataaataaggcgtacaactttaaagaagaaaggtcatttattaaactttcaattatttctatgttaggaatattagcattagctgtaactataattctagctttaacagcgttagtatttggaaatgtaataggcgattatattaaaagtatcaatccattttatgaaataatattgattatttggaatatattcagatatacttttatattagcgataatgatatctatatttatttgcgtttataaatttgctcctgctaaaaagttggtatggaaagaggtaatcgcagggtccatatttagcacagtgggctgggtgctagtgtcctttgttttttcattttatatcgataattttaataattattctaggttttatggaagtcttggtgcagtatttatacttatgacatggttatttttaatatcaataatattcatcttaggagtagagataaattttgttacatctgagttaagaggtagaaatcgaatgattagaaacaggtagacaatgatattaaattttattataaagtttgattttttattgaatagaaattaccgaagtgggtataactttagaagaaaaatattcaggaggtaaaagatgaataagataatattattaggaagattagttaaagaccctgaacttaggcacactgaaaatggagaaaaaatttataccaagtttacaattgctgtgcaacgaaattttagattacctgatggaattagagaagcggattttatacctataaaagtttggggaaaaaaagctgaagttatagtaaaatatatgaaaaagggaagccttattactttaagcggtagattaagaactggtagttatgaggataaggagggaaatagaaagtatatagcagaggttatagcagaagattttaagtttcttgagaataagaaaagtcaaactgaggcgttgtaaaaatattagcctagttgattttaataatataagctatatggatagataagtatataactataaatatacttatttatagaagaggttatctaattgttagatattatcaatgcgtttagataacctttgtgataacataaaaagtatatttttacttacaaataaaagtatgcttaaaataaatattcttttaataaaatgcttgattataaaaaacgcttatgatattagtttaatttaatagaactaaaaatgaatactaaagtcattaaagtaagataagtagtgtttatatagaaatgaaaaaaatgttttttatattgtaataataaatgaaaaatatttgtagaaaaagtgttgtatttatgtgaatatgtgttataataatattgtaaacgatatctattatatatttttcaattatggtgaaacaaaaaaagagattatgaggtgaaaaaagagctattggctctttttttatttctttatgataattaataaggtttcgattgtaaataaaagccatattaggtttttgaaaaatatatacagtgcattattcgtctgatttcgacaaaagactttttttatatgaaaatttaaagaatgtatatgttgtaaaaaataaaggaagaagttttattgtcaataaaaaaaatataaatcttgaaaaagaggacatgctttgacaatttattgatacattatgtgatactataggtttgtaaacaaggaattactatcttgagggagttgaaagggttatgaatttggttgaggaatatacatcaattaatagtgatgctgatgtagagtataaatatgcatataggcttataaaaaaggattataaggggataactgcatatggaattgaagttgaaagaaaagattatattggtttaaaaaatgtgaatttagagagagaaaagatagatataatatcaattcataggtacaaagtaaaacaattacttatgaaattgtttaataatcaggtatcaccacttcacttaattgatattatagggacgtatgtggatgagcatgcttatgagtttgatattggtatgggagagaaagttataaattaatattaaggtatagaaataattaaatatttacgctagtatatggtaagagattactaagaaaggcgataaatcatgattattggaattggaacagatataatagagataagtagaatagagcgtgcgatacaaagaacaaatacttttattgaaagatcatttacttgtaatgagattgcatatttcaaattaaaaggatttaaggggaatgtagtagcaggaaattttgctgctaaggaagcgattagtaaagcaataggaactggatttagaggatttggattaaaagatattgaaatattgagaaatgagttgggaaagccaatagtgaatttaagtgataaaatatataacctattggagataaaagaatttaatatgcatgttagtatttcacatagtaatgaaaatgcgatagcttatgcagttatggaggcaatataatgttagaaattttttcggctaaacaatgtagagaaattgatagagaatgcattgattatattggaattcctagtatcgtattgatggaaaatgctgcgataagtttatttggggagatttcagataaaggtgaatcgtttttaatattatgtggaaaaggtaataatgggggggacgcccttgcattagctagacatttgatattagatgggaaaaaggtaagggtttatattctaagtaaagacgaaaattacagtcaagattttaaaattaactttgggatattagaaaaaataattgaaaagaatgacatattatttataaagtcagagaacgatatagatgaaaacgtaataagtgatattaaagactatgacctattaatagatggaatttttggtgtcggccttaacaaagatttagtgggaatgtttaaaagtattatagaatgtataaatttatatgcaaaatttgtggtggcgattgatacgccatcgggtttagactgtgacttaggtattgagagaggaatcgcggttcatgctaatataacttatacatttgaggtcgtcaaacagggctttttagattataaagctattgattgtgtcggaaaaattaaaatattaaaaataggcattccagagtatataaaaaagaaaaactctaataatttttatatactagaaaaaaaggaatatagtaagatgcttttaaaaaggcaggtttatggtcataaaggagattacggtagaggagtagttgtagctggaagaatcggatttactggagcagcctttataactacggaatgtacggttagagcaggtgcgggattgactacactagcatgcagcagtgaggtgcaaaagatactatcaagcagattaacagaagctatgacattagactatgaagataatgataactttatagaacttataaaaagagcaagttctattgcttttggtcctggaattggggctggagaaagagaaaaaagcttgttggaaaagataataagtaacagtaaatgtcctattgtgattgatgcggacgggatatctattataggggaaaataagtacttgctaaataatttaaagggtagggcaattattactccacatccaggtgaaatggcacggtttctaggaatgagtattgaagacgtggaggctaatagagtcagcatagcaaaatcagttgccatgcagtatggaataattgttttattaaaagggtataataccgtaatttcgaacggaaaagaagtttatataaatcctactggcaacagtaagatggcatcaggaggcatgggagatgcattgaccggaataataaatgcatttctgtcacaaggagctagcataaatcaggctgctcttttaagtgcatatattcatgggaatatagctgataaattaagcaaacaagtttacatagtaaatgcaagagatattatagccgaattacctaaagaaattaacagtattattgattaattaagaataaagtcactaagattttcataaatagtaatatgtagtaataaatcttaggaggccttatggattttagaaaagtattgttcaataaaaaaataattataggtattttggtgcttattccagtacttatgattttgttagttattttatgtagagatgtaattaccccttcaaatgaagatataattagtgaactgaaagatacaaagtattacagtagtaaagttgattatttgtttaagaattctaagtcggaattcgaggaaaatacaatgcaatactatagttttgataaggggtcaagaatagaattcggaaatgactataacagagttaaggtttataacggttcagagataaaagttgagggtgacgaagataaagagggatatacacttgataaggatatagacgtaatttatcctttggcattcatagaaaatatactatctaataagcaagctgatgaaataaaagaggttaaagcagattggggaccaggagtatatttacaaatagatatagaatttaacagcaagaataagcatttaaataaagctgaattctatgtagataaggataagaaggttccagtattattaaagattttagatgatgataataaagagagagtaatagtaaagtatagtgattttaaaaaagaaaaaacattaagtgatgatttattttgatttaaataaatttattaattagaaatcaagccaacattaatattaaaaaacgatatactaaatctaaatataaattaaagtacatattagaaattttgtagagaaaacatttaataagaattatctagagaatggtaaagaagtaatacaaatcctttgacaaattgacataatttgcaatataatcatagttataagaactttttactgctatggaggcgaaaagatgtcaataattaatctaaataacatgaaaaataaaaaaatagttaactcagggaataataaaattaaaaaaaatagtggaattatggagaaatcgttaatacaatatattaacgaaggattttcagctgattttgaaaaactaatgaaaaatggttatcaagaaatggctgaaataaacttggaatattctaaattaggttttgaatatatgttagatgatgttaatgagtatgaggcatggatttgcggagtgtgattatttagaatggcaaacattgtggtaaaaagaggggaaattttctatgcggatttaagtccagttataggatccgaacagggcgggataagacctgttattataatacaaaatgatattggaaatagatatagtcctactgttattgtagctgcaataacatctcaaataaataaggctaagcttcctattcatgttgaaatttcatcagaagagtatggattaaatagagattctgttgtcttattggaacagataagaacattagataagagaagacttaaagaaaaaattggacatatgactgaagcagacatgaaaaaggttgataaagcattagcggttagcttgaatttaagctaaagagaaaacaaaagggttttatatctattagtattaggagtggtatagataatcttttttatttgtactactctttttgtgcgtgagaatactctatattatatgaatatgcttaaaagtatatcacattaatgaatgaggtatacaaaatatattttgtatgctagaataaatatgttaaaataaaacataatataaatgagtaaattaataatagggggttgtataatgaataatgaatacaaacttgaagaaatctcaaagttaatgagaaaagatatagtttctatgcttacagaatcatcatcaggtcatccaggaggttctttgtcaatagctgatattatgtctgtattattctttaaagaaatgaacatagatgtatctaacgcaaaagatccaaatagagacagatttgttttatcaaaaggccatgcggcaccagcattatatagtgctttagctagaaagggatattttgaagtagaagagttaaagagcctaagaaaaacaggttcaagattacaaggacatcctaatatgaatgatttaccaggaattgatatgtctacgggctcgctaggacaaggaatctctgcggcagttggaatggcattagcaggaaagcttgataagaaggattatagagtatacgcaattttaggagacggagagcttgaagaaggccaagtttgggaagcatcaatgtctgcagctcattacaaattagataatttaactgcatttatagataataatggactacaaatagatggaaacatagaagatgttatgaatcctggtcctatagataaaaaatttgaagcttttggatggaacgttttgactataaatggtcatgattatgatgaaatcataaatgctatcgcaaaagcaaaggaagttaaaggaaaaccaactgcaattatatgcaacacagtaaaaggtaagggtgtttcatttatggaaaatcaagcaggatggcatggaactgctccaaataaagaacaatgtgagcaagcattaaaggaaattggaggggaaaactaatgggaaataaagtagcaactagagaagcttatggtaaagcgttagtaaaactttcaaatttaaataaagatgttgtagtactagatgctgatttatcaaaatcaactaaaacagctgattttaaagctgtttcaccagaaagatttataaatatgggaatagcagaatcaaacatgatgggagttgcagcagggctttcaacttgtgggaagattccgtttgctagtactttcgcaatgtttgcagcgggaagagcttttgaacagataagaaattctatatgttatccaaagttgaatgttaaaatttgtgcaacccatgcaggattaacagttggagaagatggagcgactcatcaatccatcgaagatatatcgctaatgagaagtattcccaatatgactgtaattaatccggcagatgatatagaaactgaagcagcaatattagccatagcagaatacaatggaccttgctatgttagattaggaaggttagctgttagtactgtaaataacatagataattataagtttgaaattggaaaaggtgtgacattagcacaaggtaacgatgttactatagttgcaacaggactaatggttgaattagcgttagaagctaaaaaagagttggctaaagatggaattgatgctagaataataaatatacatacaataaaaccaattgataaagaactattagctactgcagcgagagaaacaggagcaatagttacagcagaagaacatagtataattggtggtttaggttcagcagtcgctgaagttttaacagaagaatgtccagtaccagtattaaaagttgggataaaagatacttttggtgaaagtggtaagccaaacgaactattaaaagcgtatggattaacagtagaagccatagtagagcatagtaagaaagctatttcattaaagaaataatcaacccagaataatagaatataacataccgaaaatgcaagatacaaagcttatgaaatagctgaggatcttgcattttctatttttgaataatcaaaaataaacaaggaaaactatgagagaaattctaatataaataaaaattaaaaggggaagatgacaatgaaaaaatcaaaatttagagaatatttaataataacatttgggataattctggttgcgctttccattgagtacttttacgctccaaacaatattgcagcaggtggagtaacaggaatagcaataattattaatgcggtcataccatctttttcaataggtgtagtgagctttattttaaatggattgttatttatagttgcacttatattcattgatggaaaatttggtgtgaagacgatttatgctagtttaggattatcagttataatatgggcaattgagaggttcttaaagccagtggcaatcacaaatgacttaatgatggcaactatttttggaacattaatttcagcattcggaatggctatcatatttaatgaaaatgcatcaacaggaggaacagatatattagcaaaaatgctaaatatattttttcatttagatataggaaaatctttattggtagtagattttgtaataaccttagcaagtgcgtttgtatttggagtggatgttgcgttgtattctatgctaagtataatactacttggtttaatagttgatagagttatagaaggatttaatgcttgtaaaagtatatttattattagtaaaagtaattatgagataagtagatatataatagatacattagatagaggctgtacatttataaatggagtaggggcatttacagagaaggaaactaatatactttatgccgttttaagtaggaatcaattcataaaattgaagaagtttataaaagatgtagatcctgatgcatttataacagtgggggaagttcatgaagtattaggtgaaggatttaatgatataaaacaacattaattaccaacaaatggctccaaatttaataaaattgtataacattagaaagtattcttatgttataattaattttgtaggttttgcaattaatttgcggaatatacaataaagaaggagtgtttgagtatgatcgagtttagaggagtatctaaaatttacaataataatgtaaaagccttatcagatattaatgttgagatagaagcaggagaatttgtatttttagtaggcccaagtggatctgggaaatctacttttataaaaatgcttttgaaggaaattgaaccaaccaacggaaaaatattaataggagataaagatttatcatctattactaggcagcaaataccttattacagaagaaagataggaatggtattccaagattttagattgataccaactcttaacgtatatgaaaatgttgcatttgctatgagagtagtagaagcatctcaaaaagatataagaagaagagttccaatggtattatcgttagttggattatctcataaatataaaatgtttcctaatgaattatcaggaggagaacaacagagagtttctttagcacgggcactagttaataatccatctgttttgattgctgatgaacctactggtaacttagatccagatacagctagagaaataatgtcattacttgaggatataaacaagtctggaactacagttcttatggctacacacgcaaaggaaattgttgactatatgaaaaaaagagttatagctattgaaaaaggagaaatcgttagagacgagaaaagaggtaagtacgaagatgaaaattaatactattgcacattttattaaggatgcatttacaagcttaaaaagaaataagactattagtattgcttcagtaattactgttcttataactttctttgttttgggaatattcgtattagttgctaataatataaacaaaggaataaatactgttcagaataaagtagaactaaagatatttcttaaggatgatataaaacttattgaccaaagggagatagaaataaaattacgagaaattgaaggcgttaaagatgtaatttaccaatcaaaagaagaagagtataagaattttcaaagtactacgaatgaaaatgaaggattactaaaaggatatacattgcaaaataatcctttttcagcatcatttacagtaaaattagaatctccagaatatgcgtcagccgtaagtgaaggaataaaagacttcgaaggtgttgagactataggtgatcaacaagaattagtagacaagattgtagggatagtaaatggtgtaaaagtagttggttttgggttatttataatattagtgggtgtttcaatattcttaataatgaatactacaaaactaactgtatattcaagaagaagagaagttggaattatgaaatttgtaggggctactgattggttcattagatggccatttgtaatagagggaatggtaatagggtttattggagcaacattagcatgtggagctttatttgcagcatataatggactagttaggtggattgcttcgcaattggtatttgtaagccttgtaccagcaacgtttatattctcaactctattatggcaatttatgcttggtggtattatagttggtggaattgctagtataatttcattaaggaaatttttagtggtataatttttgcaaataagtgtaaatataataaaaataggaataaagaaaaatagtattttatactatgaaatcttgagaaaaactttacaatataatccactttaatctataaagatatatattgggattatatgtatgatgcatatgaaagggagtctttataggtgaaggaatcaagaaaatacatatttgcaaatagaaggcaaaatagaaaaataattttaataccaacagtaatctttatagtatttcttatatgtgtatcctttttaggaggaaactatattgctactaaagggatatttctagtaagaacatcgccagaagtcaagagtacagcttctcagataaatgataagagtaaatattcagcactttttacagttagagataaattaattgaaaagtttgatggtgaaattgatgacaatgctcttttagaaggagcgatcaagggaatgactaattccttaaatgatcaatatactgtatttatgaatcaaagcgaatttgatgatttaatgaaacaaagtagtggaagtatgacaggaataggtgttactgtaacgttaaaagataaacaggtaacaattttagatactgttaaaggagcacctgctgatagggctggactacaggaaaatgatataatagaaaagataaatgatatcgatgtgtctggtgacgatttaaaaaaagcaacgtctatgattgcagaggcaaataattcagagttaaaactgactattaagagagcagatactaatgaatttgatgttaatgtaacacctgaaaaagtaaagattgaatcagtaaaagggaatatgctagattcttcaatagggtatattcgtataaaaactttcatgaatgaaaatacggcagaagatttcaaaaacacaattgatgaattgaaatctcaagggatgaaaggcttgatagtagatctgagagaaaatcctggtgggctattaacagaagcagtaggcgttgcatcacagtttattccgaaaggaaagataataacttacacaattgataaatatgaaaacagaaatgattcattatcaattggtggagatgctgaaggcatgccattggttttactagttaatgaaaatagcgctagtgcatcagaagttgttacaggtgctttaagagattatggcgcagcaacaattgttggaaaaactacttttgggaaaggtatagttcagcaaacagttaaatttgatgataatattggtggacttaaagtaactatttctaaatattatactccaaatggagagaatattcataaaaaagggatagccccggattttgatgttacaacacctgttggtattgatgaaaagagctatgataaaaatgctgatgagcagctaaagacagcggttgaaaaaataggagaaaagattaaatagggagggattaaatgggtttatttatatatacgctacggagcgtatcaggtgctatagtaacccctccattagtattcttattaatactcttaataatggtactacattcaaagaacaaaaaagtagtaactatgcaaaaaataattttaggaggtagtgtaaattcatctattgaacttacactatctcaacttgttttaggaattataggtggaattataggaagcataatacttacaagtttaggtgtagtttttagtgaaaattctggaatatcgtatttgtttgttatatcaatattattaatgcttataagaccaaggttaatatgcttttcttattcgggagcaattctaggtggtatagtaattataattaaattgattaatatattcattccttatagtttaggagtttttgatctaaatatattttatttagcaattcttataggagtattccatgttattgaggggatattagtaattgtcgatggagatagaggagctgtacctgtatttacaaatagagataataaaattttaggtggatatgcattaaaaagatattgggcattgccaatagcaataattattgctatgaatgggaataattcgatgttgagttatatgacagaatctatatctaatccagattggtggccattaattaaactaccatatggactcgcattaatagctggaagtattatttctatagttcctttttatatggtattaggttattcatcaattacatttacaaaaagtaaaagagaaaaagctatatcttcaggagtacacatactagcttatggaattcttctgacaatttcggctcagattgctaggtttggaattattggtgaagtatttgttgtgatttttatgccagcagctcatgagttaatgcttaagcttcagacagatcgagagaaaaagcaagtggctaaatttgttagcgatgaagaaggtctggtagttttagaaatgtcagcggattctaggatgcgggaatttggagttgatattcaaagtaaaattttatcagtgaatggtaaaaagattaattccgaagcggaagtgtattctattttaaaggaaaacttatataatgcagttttaaagataaaggattctcatggaatggtaaaagatattcaatttaggcataataaaaatactaggcttggaattttagtagtacctagaaatgtaagcaaggaagatattgtgccagtcgatggaggaaattttaaaaatgttttaaattcattaaaggggtctgaaaataaagttgaatataaaatagaaaaagagaatgatggaaaacatgataaggatgttaagaataaagataataaaatgtaattagaaggtggcttggccacttttttctttaactaataataatatttttatttgagcgatatttaagatgaattttatcttttttaataaataattttaattacaactgatttaaataaagtaaacatctaataattataatattttagatatatggagagtattaaagacatgagtaagcatttaaaataaataggataatttattgacttaatacttaaggaaaagtaaaatagacatataatacgaatgtctgttcggatcggaggtaatataatgggagaatttaaaatacaatcgagatttaaacctacaggggatcaaccacaagcaatcgataaattagtcaattccataaaaagcaataatagagctcaaactttgcttggagtaacaggctcaggaaaaacatttactatggcaaatgttatagaaaaattacaaagacctactataatattagctcataataaaactttagcagcgcaattatgttcggaatttaaggagttctttcctgataatatagtagaatactttgtatcttattatgactattatcaaccagaagcatatgtgcctcaaacagatacctttatagaaaaagatgcatcaattaatgatgaaatagataaattaaggcattcagctacttcagctctttttgaaagaagggatgtaataattgtcgcatctgtttcctgcatatacgggctaggtaatccagatgaatataaaaagttgactataagtcttagaactggaatggagaaagagagagatgaggttataaagaaactcatagaaattcaatatgaaagaaatgatatagatttttcaagaggaacttttagagttagaggagattctttagatataattcccgcttcgtattcaaataaagggattagaattgaattttttggggatgaaattgatagaataagagaatttgatgtattaacaggaagtatcctaggagaaagaaatcatgtagccataactccagcatcccactttgcaacatctagagagactgttgataaagcaattggcataattgaaggagaattagaggagaggcttagagaacttaatgctcaggataaacttttagaagctcaaagattaaggcaaagaactaactttgatattgagatgataaaagaaatgggatattgtagtgggattgagaattattctagaatattagacggtagagcttcaggaacaccacctaaaacattaatagattattttccggaagattttcttatgtttatagatgagagccacgtaacattacctcaggttagagcaatgtatgcaggagatagatcgagaaaaaatacattggtagactatggatttagattaccttgtgcatatgataatagaccgctaaaatttgaggaatttgaaaagaaaattaatcaagtagtgtttgtaagtgctactccatcggcttatgaaatagataattctgaagaaatcgctgaacaaatcataaggcctacaggattgttagatccagaaatcattataaggcccattaaaggacaaattgatgatttatatggagagattaataaaacgatagagtgtggatttagaatattaataactacattaaccaagcgtatgtcagaagatttaactaaatatttaatagaacttggtgttaaaacaacttatatgcattcagatatcgatacgatagaaagaatgaaaataataagagatttgaggcttggtgagtatgatgtacttgtaggaataaatcttttaagagaaggattagatataccagaggtagctttagttgcaattttagacgctgataaagaaggatttttaagatcagaaacatcattaatacaaacaataggaagagcggctagaaattcagaaagcaaggttataatgtatgctgacaatataacaaagtctatggataaagcaatgaaggaaacggaaagaagaagagctatacaaaaagattataatgaaagacatggaatagtaccaacaacaataattaaagatgtaagagatattatagaagcaacaaaggttgcagaagaagtcgaagaatataaagctgcggataagaaaaaacttactaagaaagaaaaagataagttaattaaagatcttacagaagaaatgcttttagcggcaaaaaatcttcaattcgaaagagcagctgagcttagagatattattaatgaaattaaggatggaaagtaatgggtaataatcaatatatgatatattgcataaaactatgaattatgtattgtccattaagtaggaggttagtttaatgaacgataagatagtaataaaaggtgcgaaagttaataatttaaagaatgtaagtttagaaataccgagagataaattagttgtacttacaggattatcaggctcaggtaagtcatcattggcctttgatacattatatgctgaagggcaaagaagatatgtggaatctttatcttcttatgcacggcaatttttaggacaaatggataaaccgaatgtagaatatatagaaggattatcaccggcaatatcaatagatcaaaagactacaagtaaaaatccaagatcaacagttggaacaataactgaaatatatgattatttgagattattatatgcaagagtaggaattcctcactgtccaaagtgcggtaaagaaattactaaacaatctgttgatcagattgttgataaaattatgggttatggagatagatctaaacttcaagtattatcacctgtagttaaagggagaaaaggaactcatgaaaagatattagaacatataaagaagagcggcttcgttagagcaaggattgatggggaaatttatgacttaactgaagaggaagtaaagttagataaaaataaaaagcataatattgaagctgttattgatagaattgttataaaggaagggattgaaggtagacttacagaatctgtagaagcgtctttaaagatgggcgaaggattagttataattagcgttattggaggagaagaaactttatttagcgaaaattttgcttgcccagattgtggaataagtattgatgagctatcgcctagattattttcatttaatgctccatatggaaagtgcgatcattgtgatgggcttggaagtcttatggagatagacgaaaagcttgttatacctaatagagagctaagtgttatggaaggagctatagcaagctggggaagcggaaggctaaaagaagattcttggacatatgcaatacttcaagctctaactaaagagtatggattagatttaagcaagcctataaaagatttggataaagaacatgttgatttattgttgtatggaacaggtggaaaaaaacttaaaattgaatatgtgaaagatggagttaaagctatttatagttatgcatttgaaggggaaattaatgcattaagcagaaggtatagagagagtaattcagatcttataaagggtgaaatagagcaatacatgagcaatgattcatgcccgaaatgtaaaggcgctagattaaaaaaagaagtgctagcagttactgttggtggaaaaaatatatatgaatttacaagtatgtcaataaaagaagaacttgagtttataaatggagtggaattttcagaaaaaaataaacttataagtgagcagattataaaagagattaaaaatagattgcagtttttattagatgttggtttagattacttaagtttatcaagaaattctggaaccttatcaggtggggaatcacaaagaataaggcttgcaacacaaattggttcagcacttatgggagttctatatatattagatgaaccaagtattggattgcatcaaagggataatgataggctaatacatactttgaaaaatctaagagatgttggaaatacagtagtagttgtagaacacgatgaagatactatgaaggaagcagattatattgttgatattggaccgggtgcaggagagcacgggggagaagtagttgttgctggaacacttgatgaagttaaggcatgtgaaaaatcaataacaggtcaatatttaactggaagaaaatcaattcagataccggtagctagaagaaaaggtaatggacagaaaataaaaatagtaggtgccaaagaaaataacctaaagaatataaatgtatcaattccacttggtactttaactatggttacaggagtttctggttctggaaaaagtactttagtaaatgaaatactctataaaggtttaaatagattagtgaacaagagtaaaaatcctgtaggaaaccataaagaaataattggatatgaaaatatagataaaataatagatataaaccaaagcccgattggaagaacaccacgttctaatccagcaacttatacaggcacgtttgatataattagagagcttttttcacaaactacagaagctaaaatgagaggttataaacaaggcagatttagttttaatgttaaaggtggaagatgtgaagcttgttctggagatggaataataaaaatagaaatgcaatttttatcagatgtttatgttccatgtgaagtatgtaaaggaaagaggtataatagagaaactttagaagtaaagtataaaggcaagaatatagatgatgtattaaaaatgactgttgaagaagcattgaagttctttgaaaatatacctagaattgagaataaattgaggacattaaatgatgtaggacttggatatattagattaggtcagccttcaactcaattatcaggaggagaagctcagagaattaagttggcatacgaactatcaaagagaagcacaggaaaaaccctttatatattagacgaaccaacaacaggattacacgtagatgatgttagtagattaatagaaatacttcaaagtttagttgaaacaggaaatactgtagtagtaattgagcataatttagatatgataaaatgtgcagactatttgattgatttaggtccagaaggcggagataagggtggaaccatcataaaatgtggaacgccagaagaattgtgtaaggttcaagaatcttatacaggtaaatatttgaaagatgtgcttaaataaaacttatgaatattaatgaataggtactcatatttagaactatataatattaaaacctataattggtagttataatgctcaattggcaatatatataatataaaattaaaaataataaagtttttatgaagaaattatattgaaaattgacaattggggcattataggacagaatatgataagtagatattaaaataatatagatgatataataatatatattaattaagtggcacttttgcatgccatacttacttttttattgtataatcattaatgaggtaaatgtaagttataacttataaatttctgaaagttattttacatatataatggatacaggaatgaatattgaggtgaaaatatgagtttttcgagaataattgctggtttttttggaattgtttttattattatactgtatgtaataatatactatgcgctaaagataatgtatagggatgttaaaaacggagggaagaaaagaaggcctactgcagcaaaaggaagttatggcttagaaattatagattctggaagtagcaaagatttaaaagatggatctattattcctatcagatcggatttgacaataggaagaaaagatgataattctattgtattatgtgatcaacatgtttctggaagtcatgcgagaattatcataaggaatagtagcttatttatagaagatttaaatagcacaaatggtacctacttaaacaagaataagataagtggcaaagcaaaactgtctaataaagatgagataagaattggtacggcaatttttaagattttaatttaaaatattcgaataaagagaatattaaaagaattttttattgaaaaaattaggctcagcggggaagtattgtaaagctatattttccgctgggctttacaaaagtattttagaaatctaaatatcaaaggaatagcacggtggggtgatatggattgaagataaaaagagatgaaataaagctattactgttaacttatttgttatgtatagcgctttttacaaatttagcaatattgaaagatgacatggataaaggcgctatatacatggggttgatagtatgtggcttaataactgctactcaaatattaatacggaagttttatccccatggggataaatttttgattacatttgcatgtatattgtcagtaataggtatagctgtactatatagattggatactgatattgctattaaacagttaatgtattttgcagctggaatagttgtatttattgctctagtagtgataattccagatataagagattttgttaagtacaagaaggtatatctgatagcaactctgcttataatgcctctagcattgttcgcgcatcaagaagtttatggtgcaactaactggattagaattggtggatttagtattcaaccatcggaatttggtaagataacatttgccatatacttagcggcagctttacatgattatgaagacaaaaataatataatagaagatttcaaacaactttggcaacctgcactggttgttgtatactcattaggatgtttagttgggcaaaaggatttaggatctgcgttaatattttttggtatttcattaacaatgttgtatgttgcaactggaaagaaaaagtatgtggtaataacatttatattatttgtgttgggatctatttttgcatataaactgtttccgcacgtacagcaaagagtattaatatggagggatccgtggaagtataaagatactacgggatatcagatagttcaaggattatattcgatttcttctggtggaatgtttggaagtggacttggccaaggatacccaggatttatgccagtaaatacatcagacttaatttttgcagtaatttgtgaggaattgggaatggtatttggacttggaattatgataatatatttcttgtttttctatagaggaatgagggcttcatttagaatcaaagatagattttcacaacttaatgccataggcctcagtgctatgatagcatgtcaggttctagttataataggaggagtgtttgcagtaatacctttgacagggattacattgcctcttattagtgctggaggttcctcaataataactatgttttttgcactagcaatacttcaaaagatatcggaggagggctaaaaattgaaaaatgtttctaatagtataaaacaggtaatggtagtttttttattttgctttgtagctcttatctcgtatattgcatattttcaagtcttttcggcgcctactatagctgaaagtgaaggtaatcaaaggctttgggcaagaagaaatgaagttttgaggggaaccatatatgatagaaataaaaatccgcttacaacaagtgcaagggtagatgcgctaacacaaaaaagaacttatgttaacggagatttatatgttcacgcactaggatatgtagatccaagatatggattgacaggattagaggcaaattatgatagtgagttaaccacatacaacaagcttactaacaatattttaaatctaactaaagattttagcatagataagttaaaatcaatgtttaagaatagaaaagaagatgaggttaaagttgggaatggtgttataactacattagatccaacacttcaaaaaatagcatatgatgcacttggaagtaataagggtgcagtggtagccttaaatccaaaaacaggagaagtattagctatggtttctaagccaacgtacaatccaaatgatttggaaggctcaatgaaagcttctaatgaagatagtccgtttataaatagagcagtatcaggaaaatacccgccaggatcaacatttaaaacagtaactcttagcagcgcattagaaaatatgcctggggttacaaatagaacttttaatgatacaggtaaaatagtatttaacgataaacagtcattgagcaatgataatggagaagttaatggtgaaatagatttaaaggatgcctatagattatcaagtaattttgtatttggtacattggcaatggagctaggaaatgataagttaaaagctactgcggagaagtttggttttaataatacagtagaatctgatggatttaaaatagatcagagtcaatttccaaagttatctaaagcggaaattggtagcatagctcaatctggaattggccaaagtagtattttagctacgcctatggagatggctttggttgcaagtacagtggctgatgatggtaagatgatggagccaagactcgttagccaagtggtggataaggacggtaatgtagttaagacagtggagccaaaggtgaataaacaagttataagttcagctaatgctgcaattataaaagactatatgaagaatttagttgattcaagaatcgactctacttggagttatttccaaggaactgatgcagcaggtaagactggtacagctgattataatcttgctaatggagagagcgctaaacctcattcatggtttattgggcttgcaccagcgagcaatcctaagattgcagttgctgtaatagttgaaaatggaggatacggagcgagtgcggcagcaccgatagcaggaaaattaattaggcaagcggttattggaaattaaaattaaatatggtagataaaaagtgaatagttattggagaaccgttgaaatttcttaaaagtactgaattggaaataataaaaggattttccttataaactcttcacttttttatatttgaatttaaaggagggagtgttggaatgtttgattttaaagcccaattaaaaattctaccaaatgaaccaggggtttatttaatgaaaaactcacttggagagattatctatgtgggaaaagcaaaaatattgaaaaatagagtgcgccaatactttcaaaattctaaaaatcattcggaaaaagtaaaggcaatggttaaaaatgttgctgagtttgaatacatagtgacagattctgaaatggaggctctaatattagaatgcaatctaataaaaaagtatagccctaaatataatatttcactaaaggatgataaattttatccattcataaaggtgactactaatgaggattttcctagagtttttataacaagaaattatgccaaggatggaaataagtattttgggccttatccaaatgcaggagatgtacatgaaacaataaatttgattagaaaaatttttccattaagaacttgtaaaaaatctattatagaaggcgaaaagccgacaagagcatgtttgaattatcatataaaaaaatgtaatgcaccctgtgaagggcgtatttctaaaactgaatacaaaaaaatgatagatgaaataatggaagttttaagtgggaaggataggagccttctaaataagttaaaagaagaaatgcaaagtgcatcaggaaatttagaatttgagaaagctgcatcattaagagataaaatgattgctatagaaaatatagcagaaaaacaaaaggtgtttaaatctcaagagaatgatgaagattttattaatatctataaagatgagaaagattgctgtattcaagtattctttttaagggatggaaaaataactggaagagaacattttatgattgaaaatagttcccatgaggaagatacaacaataatttcacaatttataatttcattttatggaggaacaccaaaagttccaaagaatatatacattccggaaagtgatgaaattgaagctttggaagaatttttaagtataaagcgtggctcaagggtcttcgttaaggtgccaataaaaggcgagaaaaaagaaatgttggagctagttaaaaataatgcgaaagtcactttagatcaatttaaggataagattttgagagataaagagattaatatgatttcgctaaaggaaattcaagaattattagaacttgatagtataccacttagaattgaagcttacgatatatccaacatacaaggggtagattccgttgggtcaatgattgtatttgagaatggtaaagctaagaatagcgattatagaagatttcgtataaaaactgtaaaaagtgctaatgattatgatagtatgagagaaattttagaccgaagattcactcatggattaaaagagatcgaagagattcaaaataaagagattaaattttctagtggaaagttttcgaattttccagatttaattatgatggatggtggaaaaggtcaggttaatatagctcttgaagtattagagaaattaggaatagatatacctgtatgtggattggttaaagatgattatcatgcaactagagggattatttataataataatgaattaataataaatagaaattctaatttgatgcaaatgataagaagaattcaggatgaagttcatagattcgcaataacttaccacagaagtttaagagataagagaacgcttcattcaatattagatgatatacctaatattgggcagaagagaagaatgtctcttttaatgaaatttggaagtatcgataatattaaaaaagctacattagacgaacttcttgagacagaatcaattgatacgaaggcagctaatagtgtattagagtattttagaaatacaaaataaaagaaatcaggttggggtatctcaacctaatttttagccttagattattgtaccaatgatgtataattaaaatacattatgttattttttgaatatatattaaaaacatgaacaaaataaataaattatgctataatagtacggaataaaaatttacttgtcttagattaatatttaaattattctatatcatgtaaacaaaaagcagattaatataaatgtttgaggagttttggcatgaagcactatggagaatataagaatttgttcagcaaattatacgaagagtcacaaattcaattagatgcgaaaatgagtgaacatatatactttaaagttggaggaccagtagacatacttttaactccaaacagtatacaacaggtaaaagaaactattactatttgtaaagaaaataatataccattttatgtaataggaaatgggtctaatatcttagttaaagatggtggtattagaggtgttgttataaagttatgcgagctcaataaaatagaatgtataggtaacaagattattgcagaatgtggagcattacttaaagacgtttcgaaggcagctacagaaggatcactagcaggatttcaatttgcttgtggtattccgggtagcgtaggtggagctgtattcatgaatgcaggagcttatgacggagaaatttcatttgttattgaaagtgcagaagtacttgatgacaatcaagaaattagaataattcctaaatcagagttgaatttaggatataggcagtctgtagttatgcaaaagggatatatagtattacgcgcaacttttaatttagttaatggcgataaagaaaagattcaagctagagttgatgaattaactaaaagaagagaagaaagacagccgttagagtatccttcagcaggtagtacatttaaaagaccagaaggctatttcgcaggaaaattaattgaggatgcaggattaaagggatttgctatcggcggagcgtgtgtttcggagaagcatgctggatttgttattaattgtaagaacggaacagctaaggatgtattagatgtaatatatcatgttagggatgaagtgaaaaaacaatttggagtagatttatatcctgaagttagaatttggggtgaagattaagcattttagtgattatattagttttgaaaatataaataaaaatagaagttgaagatgttaaatatatctgtaaaataaacactaaattatataaaactcaagagtttagagacttttgggttttttatgatttaattataatagtgtgatataattttgatgttaaggtaaattagaagtaatagttgtgcctagaagacgtctttggcaaaagggagtgtgtagtatgagatttgttattgttacaggattatcaggagcaggaaagacacaagcaacaagaacattggaggatttaggatatttttgtgttgataaccttccaccaaagttaatctctaagtttgcagaagtatgcacgcaaagtggcggaaatattgaaaaagtagcattagttatagatattagaggcggaattttctttgatgatttttttgaagccctaaattacttaaagaaaaatgaatttaaatacgaaatattatttctagaagcaactgatgaagtgcttattaagagatttaaggagacaaggagaagccatccattatctccagatggaagagttttgactgggattactcaggagagagagaaattaagagaagttaaaaatatagctgatattatcattgatacatctaaatacgaaataaggcatttaagagaaaaaataaacaagaattatggagatcatacttatcctgaaaagcaattatcaattactgtattaagctttgggtttaaatatggaataccagtggattcagatttggtttttgatgttagatttataccaaatccattttatatacctgaattaaagcagtattctggtaatgatgaaccagttaaagattatgtcttaaaacaagaggagactgtgaattttatagaaaagttagtagatatgttaagatatttaatacctaattatataaaagaaggaaagagtcaattaattatatctataggatgtacaggtggaagacatcgctcagttgcaatagcaaatgaagtttatgaaagattaaataaagaaaactataattctaaaatagagcatagagatgtagctgaagatcttcataaaggagaaaagaagctatgaggataaaagattggcttaaggctggaattaaagtgaaacgatggctagcgtttggtattttcggaatattattaatatcatttggatttacagaactagttaaccatagggtttacaatttatattaccaggttttttatgtgtttttaaatattacaggaatatttgttttatatatatcaattactgaaacgatgaaatcaataattgctttagtaaatagaggctatatcaaagtttctctagatagcagaaaaattgaaagtctaatatatgaaaaaagattattagtaaagggtcctaagatagttgtaattggtggaggaactggtttatctacaatgcttcgagggttgaagtactatacatcaaatataactgcaatagttacggttggagatgatgggggcggatctggagatctaagagaagatttaggaatgttgcctcctggagacataagaaactgtattttggcattagctgatacggagccaataatggaggatttacttcagtatagatttgctgatggaaggttaaagaatcaaagctttggaaatttattcttggcagctatggctggaatatctgacaattttgaggaagcagttcagaaaatgagttctgtattagctgtaacaggtaaagttatacctgttactttggataatatgcaattagttgcaaaactacaaaatggtaatatagtaaaaggtgaatcgcaaattccagaagaagctattgaacaaaaatctagaatagaagaactaaaaatagttcctgagaatgcaaaagctcttccagaggcattagaggctataaaggaagcagatgctatagtaatgggaccaggtagcttatatacaagtataacttctaatttgcttgttaaagatattgcaaaagaagttaggaagagtagtgctatcaaaatatacatttcaaatataatgactcaacctggagagactacgggttttaaagtgtcagaccatttaaaggttttattcaaatatggtgggaaagatattgttgattatgtaattgctaatacaggagaaataacagaggaattaaaagaaaaatatcaaaaagatgatgcggagcttgttaaattagatagagaagacattaatagtctaggtgtaaaaatagttggggacgatttagtaaaagttaaaaatggattgataaagcacgattcagataagttggcagaaatattagtagatacaataatggaaaagaaacttttatatgataagaaaaagataattgaatatatgtatttatcgcaacgtattaaggaaagagtcagagaagaaaaaggaaaagtaattgattaattataaactataagaaaatttatagataaggaaggaaacagaatgtcattttcatctaaagttaaaggagagatatgcagatatatagatatttcgaaagaagaggcgttagcagaaatatcggctattatgaaggttagtggtacattagcttttagtggaagtggacttagttttaaaatgaccacagaaaacccagctagtgctagattgatttttacacttttaaaggatcactttaatatacattcaaagttaatggtgaaaaagagtaactccttaaagaagaataatatctatatggtagtaatttctgaagaaatgggtgttagggggctattaagcgatacaggaatactcaaagaaattgatggaataatgagcttagattatagaatagaggagtatatttttaaagatgaagatataaaaagagcatatataagaggcgcatttatcggcggaggaagcataagtaatccagaaaaaacttatcatctagaatttgtaactcatagtgaagaatatgcaaaagatttatcgaatttaatcaatactttcagtttaaattccaaggttatacagagaaaaaatagtttcatagtatatatcaaagaaggagaacaaatagtagatttgcttaatgtaataggagctcattcatcgcttttagagattgaaaatataagaataatgaaggaaatgagaaataatgtaaatagacttgtgaattgtgagacagcgaatctttctaaaactgtaaatgcagctgtaaggcaggttgaaagcataaaacttatccaatcacagattgggatgcaaagattgccagataatttaagagaaattgcagagcttagattgaattatccagatgaatctctgaaggaattaggagaaatgctagatcctccagtaggaaaatcgggaataaatcatagattaagaaagatagaaaagatagcagaggaattacgaacaagcaaataataaaattaaagggagagggtattatgtttacacacattgtattatttaaattgaaagagccaacaacagaaaatttgaaatttgtagaaaagactttattatctatgaatggaatgatcaaggaattaaagcagctagaagtaggggtagatgtaataaaaagtgatagaagttatgatgttggaattataacaagatttgataacaaggaagattatttatcttatgacgtgaacgaatttcatgttgaaaaagttaaaaaggttatagggccatatatggaaggcagtaaaactttagatttctaaataacatatggtttaagatttatagtttagttagaaaaattctaaagaaactgtaaattttaaactataaattaactgttaatttaaagaggaggtgaggataatggaagaaaaacaattttgtcatttacatttgcatacagaatatagtttacttgatggatcaggaaaaataggaaagcttatgaagaaggcaaaagaattaggcatgaagagtattgctattactgatcatggagttttatatgggcttgtagatttctataaggcagcaaaagaaaatgatataaaacctattttaggatgtgaagtttatgtcgtaccaaagtctagacatataaagcagccagacaaagagaattcaacttatcatttggttttgttagtaaagaatcaaattggatatgaaaatctaatgaaaatagtatcagttgcatctattgaaggattttattataagcccagaatagattatgaatatttaagaaaacatagtgaaggattaattgctttgagtgcatgtttaggtggtgaagtacaatcttaccatcttaaaggtaattatgaaaaagcaaaagagacagccttaacatacaaagaaatttttaacggtgacttttatattgagttacaaaatcatggaatggaagaacaaaagagagtaaatgaagaaaatataaagttatctaatgaaactggtataccactagttgctactaatgatgttcactacataagcaaggaagattctagatcacatgacgtactaatgtgtatacaaacagctaaaaccattgatgatcctcatagaagaagatatccttcagatcagttttatttaaaatcagcagatgaaatgtgggatatgttttcctatgttcctgaggcgttggagaataccattaagatagccaatgagtgtagctatgaatataagtttcacgaatctaagcttccaaaatttccgctagaagaaggtcaagatccttatgactatcttagagatacttgctataaaggtctgatagatagatatagtgtatttgaaaatcttagaaatcagaatttggattatagtaaaattgaagaagtagtagcaaattatgaagaagctaaagaatatgttgatagactagaatatgagcttcaagtaataaagcaaatgggatatattgactactttttaattgtatgggattttgttagattttcctatgaaagtggaatacctacagggccaggtagaggatctgcagcaggttcaatagttgcatatacgttaggaattacaaaaatagatccgattaagtatagtttaatctttgaacgtttcttaaatccagagagagtatccatgccagatatagatagtgatttttgttatgaaagaagacaagaagtcattgattatgtagtcgagaagtatggagcaagcaacgtttcgcagataataacgtttggtacaatggcagctagactatgtatacgagatgttggaagagctatgaattatagttatgcagaggttgatagaatagctaagatgataccaacaatgcttggaataactatagagaaggcgttagacttaaatccagagcttaaattagcctatgatacagatgaaagagtaaaggcgttaatagatgtttcaaaggatttagagggacttccaaggcattcttctactcatgctgctggtgttgttatagcatcaaagccattagttgaatatgttccattacagaaaaatgatgagatgatcgtaactcaatttggaatgaatacactagaagaactaggattacttaaaatggactttttagggcttagaacattaactgttatgaatgatgctgttaaaatgattaaagaaaatagaggagtagatgtagatctagacaagatagattttgaagatgaagaagtttataatatgattggagaaggtaatacagcaggagtattccaattggaatcaccaggaatgacttcatttatgaaagaattaaagcctgattcctttgaagacataattgcaggaatttctttatatagacctggaccaatggctgaaataccaagatacatagaaggaaagaaaaattcagaaaaagttacgtatttaactaaagaattagagcctatattaggtgttacgtatggatgtttagtatatcaggaacaagtaatgcaggctgttagagatttagctggatactccatgggacgtagtgatatggttagaagagctatgtcaaagaaaaaacataaagtaatggaggaagaaagaaaaaatttcattcatggtattgttgaaaatgatgaagtaatagtaccaggatgcgtgagaaatggaatttcagaggaaatagctaataaaattttcgattctatgatggactttgcttcgtatgcatttaataaatcccatgcagcggcatatgcagttgttggatatcaaacagcatatcttatgaagtactatccagtagagatgattgcagcaatgcttaattcaatcatgggaatcagtgaaaaggtagcatactatatcggcatagcagaggaacttggaatacaagttttaccacctaatataaacgaaagtttttctaaattcactgttaaagagaacaagattaggtttggattagcagctataaagaatgttggaactaatgttgtagcaagcatagtgaaagcaagagaagaaaagggtaaatttgaatcgttagttgattttataaataaaatggatccatcatcaataaataagcgtgcagttgaatgtttaataaaggctggggctctagatgattttgatgtttttagatctaagatgttagctgttcatgaaaaattaattgataatatatctagtgataagagaagaaatattgatgggcaaataagcttatttgcaagtgaagaattaaagaatccagaagtaaactatcctaatattaaggaatttactaagcgtaatttattagctatggaaaaggagatgacaggactttatattactgggcatcccctagatgactatgctcaaagtctgaaaatgcagacaacaaatgagatttctaaaatatttttagtacaggaaaccttagatgattctctagagagcgatatgggtgaaattaatatgtttaacaggcaggatgccttacaagataatgatagagtaatccttggaggaatacttgctagtgttaatcagaaggtaacaagaaataattctataatggcattcctaaaacttgaagacttaactggaacgattgaagtaatagtgttccctaaaactttggagaaagtaaaagaattatgcgtgacagatagtttggtaatagttaaaggaagattaagtttgaaagaagatgaaccaccaaaacttatttgtgaaagtatagaacctttagagaaggtcaatacttcaaaagtatatttaagagttgatgataaggtggcagctactgttttaagtaaaaaattaaaagaattattgataaaggaatatattggagatacgcctatttatatattcgagagcaaaggaaaacaaaagttcagggtgccaagagatagatggatttccctagatagtgatgttatgaatttattgagacaaactttaggagatgagaatgttaaagtattagattcataattagaaacgagatgcgattaaaaatttagtaaatatacaaatgaaaaatattacaaaaattaatatcacaaaaattatattattttatataaatttatcgattattggttataatagagaagacaaattacgttcattgttttataacactaaaactattataaaaatgcagttactatccttgttataaatgaagatagcttatatgaaaaaatatgatatttagcggtgtatagtcataaattcagtaaaataattttcaaattatttgtattgtgaaatttttcataaaatttagacatttattttagaataatatcagaaaatggttaaatatcattgataattggttcaaatttatgtacaataattcttgattaataaattatggttatattatgtacacaagggtcatttaaggtccctttgcggtattttaaggaggaaatatatattatgaaaaagatagctgtgttaacaagtggtggagatgcaccaggcatgaatgctgcaattagagcagtagtaagaactgcgcttcataacggaattgaagttatgggagtacaaagaggttatagtggacttattaatggagaattattcagcatggatagaaattcagtatctgatataatccaaagaggtggaacaattttaagaactgctagatgtcctgaattcaagaatgaagaagtaagaaaaaaggctgcaaaaatattacaagcttatggtgttgaagctctagtagttataggtggagacggttcatttatgggtgcaaaattattatcaaagcttggaattaaaacaataggtttaccaggaacaattgataatgatttagcttacacagacttcactttagggtttgatacagccttaaataccgttgtagatgctataaataaaattagagatacttcaacttcacatgaaagagtttcaattgtagaagttatgggtagagactgcggagatttatctttatatgcaggtatctgcggaggcgcagaagcaattataattcctgaaatggaatttgataaagatgcactttgtagaactatcttagaaggtaaaaataaaggaaaaatgcataatctaataatgcttgcagaaggaattggaggagcatttgaacttgcaaagtacgttgaagaagtaactggaattgaaacaagagcaacaatcttaggtcatattcaaagaggaggaagtcctactgctacagatagagttttagcttcaagaatgggagcaaaggctatagaagtattattaaaaggtggaacttcaagagtaataggaattagagataataaaataatagaccaagatatagatgaagctcttgatatggaaagcaaatttgataaagaactttatgatattgctcaagtattatcataataatttagcttatagtttatttatataaattttataaataaggtacaatcaaaaaataatgaatcaacatgcttgcttattttgcatatttgtaacattattttattttatgtgcctaatcgaagaaagaggagtgttagtttaatgagaaaaactaaaatgatttgtactattggccctgcaagtgaagatatggaaatattagagaaggttgttctttcaggaatgaatgcttcaagacataacttttcacatggagaccatgaagaacacggtggaagaattaagaaagttaaagaactatcaaagaagttaaatagagaaattgcaataattcttgatacaaaaggaccagaaataagaactggtaaatttgaaccaaagaaagttgaattagctaagggttctgaatttacagtatatgctggagatatggatatagttggtgatactactaaatgttcagttacatatgcaggactagcaaatgatgttaagccaggaaatacaattttaatagatgatggtttagtaggattaactgttaaatctgttgaaggtaacgctattaagtgtgaagttcaaaacactggattcgttggaactcataaaggagttaacgtaccaggagtatcaatccaattaccagctcttactgaaaaagataaatcagatttaatcttcggttgtgaagttggagttactatgatagctgcttcattcataagaaaagcatctgatgtaaagactatcagagaaatacttgatgcaaatggtggagaaagaatccttatctgttcaaagatagaaaaccaagaaggtgttgataacttagatgaaatcttagaagcttcagaccttataatggtagctagaggagatcttggtgttgaaattccaatagaacaagttccagcagttcaaaagatgatcatcaaaaaatgtaaagcagctggtaaaccagttgtaactgcaactcaaatgttagattctatgatgagaaatccaagaccaacaagagcagaagtttcagacgttgctaatgctatcttagatggtactgatgcaatcatgttatcaggagaaagtgctaatggagattatccagtagaagctgtagctacaatggctaagattgctgaagaaactgaaaaatctttagaatataaagtagcagtttctcaagctaaaacacatattccagctatagcaggagttatttcaagagcagctagtaatgcagctaatgaattagaagcagcagcagtaattacttcaactcaaactggtgcaactgctaagagaatttctcaatgtagaccagaatgcccaattatagctgttactccagatccaatagttgctagacaattagcattctcatggggagtatatccagtagttgctgataaaatggaatctactgatgaaatgttagaaagatcagttgaaatagctaaaaataatgaatttgttaaatcaggagatatagttgtattagcagctggagttcctgtagaccaagttggtgcaacaaatcttttaaagattagcgaagtaaaataatatttgaaacataattttttaatatatataaagggactttggtaggaatcctaccaaagtccctttatattctttaggaatttatattcaagtaaaatctgtggatagcataaaaaaggttgattaaatagttttggtattttaaaaagaataaaaaaagaaatcttattcgtctgcataaaatgttcttatatgcagcagagctgctatttctgatgtgcagatttttctcacatgcgttcgaaaaggcagatgcgtgaaaaaaatctacacatatgaaaagagtgcgaagtacaatacggaacttaaccacagtcgcctgcgatttttttacatggaaggttttaaatgctccttaagcataaaatccaatatatacatgcacttaagatgataaatatgtaatcaaattttaagaaatatataaagttaacaaaaaattaacatttaaagataggatatttaatatataatgtatattattgctctaaaagagaaataataatttaatgattatggaattaaatggcaactgattctgtattagcaccgcaaggtgctctttttttattttaggaaaattatataatttaatggtgctaagaggttgattaaatcgagatatcataatcatcattaattatttattacctgacaaaataaattctagcgtgagtaaattatttgatttttatgggaagttattgaaatgttaagtctaaatataatatccattataaatgagaatttaatagtttagagtttgttcttaattgtatataagaatttataaatatcttaaataaatgaataagatatgataaaatgtagaaagtatttttaaatattgatttgaaaattatagttaggaaatgatactaacagtgaaggatgtgtacatgtgttagagagaaataaagagtatattgtaaaaatagattccttaggatatgaaggtgagggtgtcgcaaagatagatggatatccaatatttataccaggagctttaataggggaaactgtaaagacagaaataatcaagaataaaaagaattattcttatggaaagcttatagatatagtggaaaaatgtgacgaaagaattatacctgaatgtaattattatgaaaaatgtggtggttgtactttaatgcattctaattatgattcacaattaaaatttaaatacaatagagttaaggattgcatagaaagaattggtggattatcgggggatatagttaaaaatactatagggatggaatttccgtacagatatagaaataagggaatatattcaattgcattgacagacaatgaactttcaatgggcttttttagtgaaaaaacacatgaagtggtcgatatggataagtgtctaattcaagatgaagaaactgataaaatcataaaaataataagaaattggatgaaaaagtattctatattacctgctaggaaagataatttattttttagtgaaggactaattagaaatgtaatggtgagaaatggttttaaaactaatgagattatggtagttttgattactaccgataaggaaattccaaagaaagaagaactgataaaggatattaggttagaggttgaaaatttaaagggagtaattcagaatataagtactaaaaataatagtctagttctcggtgacaagtgtataactttgtgggggcaggattatatatctgattatataggtaaatataaatttaatatttcgccattatctttctttcaaataaatcctattcaaacagaagtactttataataaagctttggaatatgcagatctgagcggagacgagattgtttttgatgcatattgcggtgctggcacaataacattatttttatctcagaatgcaagaaaagtctatggagttgaaatagtagaacaagcgatagataatgcgatagataatgcagaaataaatggaatagacaactcggaattttatgtgggaaaatctgaagaagtgattccagagttaataaaaaatggaatcaaaccagacataatagttgtggatccccaagaaagggctgtgatattaagttgctaaatgctataggagaagctaagcctaaacgagtagtgtatgtatcatgtgatcctagtactttagcaagagatttaaaacatttagaagggtttggatttaaaacaatagaagtacagcctgtagacatgtttccaaatacaaagcatgtggaaactgtcgcgttattaactaagagatatgtaagcccacaataatcccttaccaattcaaataaacctcttccatatttcaaataaagttcttccacgcaagaatactgcaaggaaaggacgcttgaagcttaaccagaaagggggctatccgccccgctcgttagagcgtttcaggtagatagggttagaggttaggatagagtaatggcgaggcttagagggattttagcaaggatcaataatcaatcgaacaagctttaatggataagaaaaaatagaatagaaagcaagagatttgcaagagaaaaggaaagactttatttgaattaaataaggtttttctttttatggggatttaaataacggattagaagaggagataaggaaaaactatttttgaatcggtgacggaggaaagcggggttgaggggtgtgtggaggaaaaggcttttttgaaagtaacaagataaagccattctttaaaataatataagctcaaaaacttccgacttccgacattcttccgacgggagatttagttgattggaagttgagtacttattaaattttcaaaaatgttaacgctagtatttgacattgttttaataacatgagaataaacattcatagtgattgaagattttctttgaccaagtttttattgaatatatattatgtttataaactgttcattaatgctaactttaattatagctagcattgggcaaacatctgttgaagatgtcataaacaagctatatgaggggggaggtcatgaagtatttaaataaccgactttttgaataggaattcaaaaaataatctaaattaaagattttattatcattttttaatatatttatcatctggatatggaattataatttctccattaacaattttataattagtattttctataggatttaagttgtgaattaagttcatcgcaatattataaattagctcagcttcaatctttggatcaagaacaattgtgccagtcataaagcctttatcaattaaatctttagcttcgagtagcccatcgactccaacaacggctatagttttagatttatcacctttattatagttatatttttgcaatgcttcaattgctccaattgccatagcgtcgttatttgcaactattgcttcaattttgccatcatatttaagaaataaggaatccattgactctttggccaattcccttaaccaatttccatttactagcgcaagctgctgtgtttttattcctgaatcattaattgttgaaatagcatatattgttctattaattgctgcaggattagcttttttaccttgtagcaaaatatattgtaatatattatcattatttttatctagagcatttttattattattccataaatcaacaagcattttaccttgagatataccctgttgcttataatcagatgatataaaagcaattttgttataatagttcgaaattcttgacgcagcttctggactaatgccagctaaaattattggaacatttttttgcttgaccatgaatatgacattttctattacatcttcgcttgtatcagctaagcttgctataattagatcaatattacttttaagaattgaatctaatgtctcatattgtagggaaatgttatcttttccataatagaaggtaaattgaatatccttatgttcttcttgaatatcttctaaactttgttttagttgtaatagaaataaatcatcggaattagagaataatactgcagcattaattacagaggtagtattaagattaaaagttgggttagcaaatgcattaaatttaacattaatcattaggtttaaggcagttgatattattataataaataaaattattctttttaatgttttcattaataatcctccaattcgttgtttaaaagttaataataaatattagtttttctattaatataaaatttatcctaattgatgtatatatgaattagtagatcaatagaaaggtatttataatgaagaataaggataggagatttactgaatgaatgggcaaagaagagttatatataagcaagtgttaaaaaattattaagtaaagaacggaataatggaaaagcgtaattcaagttgcggcgatataggtgtttgtgaagaaattatttgaagttgtgttgagaagtatagaaaacattgatagaatatttttattgataatagaaatctagtaatagaaaatggagaaataagaaaacttataaaagactaatatatatggagaaaatgcaatatgaaaaaagggatacgaatcttctttgaaaacgagaaataaaatagtaaaggaacatttgctgtattgaaaaagcactttctcagaaacttgagaagatcaaatttatttattatagataatggcggaactgttgatcttacttgttatgtaaatagatactagtaaatctgttcacttacagcttaaataatttggaggttaaatatgacaattgaaaatatgataaaatgttgtgataaattaactcaaacagaaaatattcttgcacagtatattattaaaaacaaaaacgaaataagtacattatctattcagcaactttcagaaaaaacgtttgtatctaaatctgcaattcacaggttctgcaagaaaataggtgtggatggatttaatgaactcaaggtaaaagttgctcaggacatagcagaggaaagtaaaatagaaaatgatattgatgttaatttcccttttttagagggtgatactcagggagtaattgcacagaaacttataaaattatatgaaacaactataagagatacatataaatatattgatgttgagaagctaaacacatgtgtgagtattcttcataaagctgatgttatagatatttatactcatgcacataacagtaatgtagcagagaattttatggacaaaatgcgttctattggaaggatggttaattgtacaaaatctttttatgatcagagatgtactgcaactgcatcaaaaaagaatcatgcagcattgctactatcatattcaggaaagtccaattttcttaagcctatttcagaggtactttataaaagaggtattgaaacaatttggataggcagggttggaagttcgagtgttccagaatatataaagcatcgattatatataagtgacagagaaaattttaaaaatagaatatctcaattttcatctcatattgcaatgcagtatatgcttgatcttatttatagttgtatttttaaaagagattataatgataacataaaatatattaaggaaattgcgaatatagttgataatagagatattactgaataaaaaaactcatcagaagaaaattctgatgagtttttttattaaagtttcaaaaagtgtcagaaaaaagagctgagatagaaaagttttagaaaaaagtatcagattatatcacttttattgaattaaaacgtttaaaattatatattagtcacaagacaagagaaaaatatataatttttaatggaggcatatggtatgaaaaaaactttaaaaatagcaacaataggtggaggaagtagttatacaccagagcttatggaagggttcataaaaagatatagtgagcttccaataggagaaatatggcttgttgatattgaagatgggagagaaaaacttgaaatagtaggtgcgttggcacagcgtatgtgggatgcaacgccttataaggtgaaggtagtaacaacattaaatagaagagaagcattaaaggatgcagattttgtaactacgcagtttagagttggtcttttagatgcaagaattaaagatgaaagaataccactatcacacggaatgcttggacaagaaacaaatggagctggaggtatgttcaaagcttttaggacaattccagttatgaaagagattatacaagacatgaaagaattatgttctgatgcatggcttattaattttacaaatccgagcggaatgattacagaagcggttattaaggagtttggatggaaaaagtgtataggattatgtaatgttccagtaatggctatgatgaaagaaggagcaacaattggagttgatgcgtcaaaattaagttatcagtttgcagggctaaatcattttcactggcatagagtttttgacgaaaagggaaatgaagttacagagcagataataaaccgtattaatgataaagaaagtggtttgccaaagaatattttctctgcagatcttccattagaattgcttcattctacgaaagtgattccttgcgcataccatcgttattactactgtgaaaaggaaatgcttaatcattccatagaggaatttaaaaaagaaggaacacgtgcagagcaggttaaagaagttgaagaatctttattcaaattatatataaacaaagatttaactataaagccagaagagttatcaaaacgtggtggagcatattatagtgatgctgcatgtgaatgcataagtgcaatttataataataaaggaatccatatggttgtaagtactcagaataatggtgcaattccatgtcttgatagtgattcgattgttgaagtatcaagcataatttcttcaagaggagcagagcctatagcatggggggaaatgagttcttttgagaaaggctatattcagattatgaaagcaatggaagaatgtacaattaaagctgctttgactggagattatggaactgcgttagaagcgttttctataaacccattagtacagcatggtaatgaagcaaggattgtattaaatgaacttcttgttgctcatgaaaaatatcttccacagtttaaaaataaaattgaagaattaaaaaaagagggtgttcactcaacagattctgttgttatagatttaatgatgaatggatactaagatgtaatgaagaattaatatttaagaggcgtagagtatgagaaaaagaatttgcgtataggagtggattaatatggatcaaaaagatatatccaatttaattattaagcatgtaggtggatctgacaacatcaaagatttatatcactgtatgacacgactaaggtttaaactaaatgataaatctaaatttgatgtggaagaattgaaaaaggtaccaggggttattaatactgttcaagctggggatgaatttcagctaataattggcgctgaggtggataaatattacaaagatttactaaaacatggggctgggaaaaatgtggaaagaaaaagcataggcggaaaatttgattttaaaagtgcaccaaaagctgctttaaatatgattgttgggatcatggcacctattattccgattattattgcaggtggtatggttaaagttattctttctttatgtgtactttttggaatgggtaataatacacaaaattataaaattttatctttaatttcagatgctccattttactttttaccattttatatagcgaatagtgctgcaaagaaatttgaaacaaatcagtttatggctatggcaattgcaggagtaatgttacatcccaatttcttggatttggttgtttctggtaacggtattgcattatttgatttgcctgttaaagcagtaaaatatggatctactgttatacctattattcttgtagtttggtttatgagctatcttgaaaagtttattgagagaataataccacaagtgttaaaaactatgttaagaccaatgttgttactgatcattacagctccattggctttaatcgttattgggccattaggagcatatatgggaaattgtatctatgtagtcattaagacccttaatgaaaacgttccttggttagtaccaactgttatgggagctttttctcctcttttagttatggtagggatgcatgtatcaattactccttttgcaatattatctgtatcccaatttggatatgaaacattcatgggtccaggaatgcttggaagtaatgttgcacaaggtggagcagctttagcaatagctttaaaagagaagaaagagaaacgacaagttgcaatttcagctggtattactgcattatctgggattacagaacctgcgttgtatggtgtaacattgaaatacaaacgtacattagtatgtgtaatgctctctggtgcaatcgctggattatatgcaggtgttacaggagtagttagatatgcaattgcttcggcaggattcttgtcattgcctgtatttataggtgctaatccacgtaatatcatcaatgcagttattactgcaataatagcattagtattgtcatttactttgacttatatatttgtaaaagtagagaatagttcagaatccgttgtagataaagaaactgacaaagctaatgaaatatttacaagtgttgcttgtggcaaagtgattcctttggaagaagtaaaggatgaagcattttcatcaggagcattaggatacggggcagctattataccaacaaagggaactatttattctcctgtagaaggaaaagtagcttctatttatccaactggtcatgcgattgggattataagcaatagtggaaaagagattttgattcatatcggcattgatactgtaaagttacaagggaaaggctttagtacttatgtagaggaaggcacaattattcatccaggcgatcgattagttgatattgatttagattttataaaagaaaatggatatgataccagtgttattgtcgtagttccaaattcatcaaaagaagatattaaagtgatagagaaagatgaattgtctataaatgatgaatttttgcagataattaattaaaaggaggagttaataaatgaaaataacaagtgtagaaatattttgtgcagattatgataaaaatgcacctaatgaaccagtatttgtaagaataaatactgatggaggtatttgtggatttggagaagcaggtgtggcttatggaaattccaagttggcagcaattggtcaaattcaggattttggtaaattaattattggagagaatccaatgaatatagaaaaaatatggaataagcttcagaaagagacattctggggactaggtggaggaacagtaattttttctgccataagtgcaattgatatagcactatgggatattaaaggaaagttacttggagttccagtgtatgaactgttaggcggaaaagtacgtgataaagtaagagcatatgcaagtcaaattcagtttgattgggacaaagattcacgtccattaggtggaattaaagaatatggagaagcagcaagaaaggctagagcagatggatatacagcactcaaagttgatcctttacagagagatgaatttggaaagaagaatttgcgtaacgatggattgctaacaaatcacaaattgaaattgtgtaaagatagattagcggaaataagaaatgccgttggagatgagatggacattatcttagaactccatgcaaagacagattttaatgctgcattgcagattgctaaacttgctgaagaatttaatatctattatttagaagaaccatgcgggccattaaatccacagttgatgtcatcactaaaagaaaaaacaaatattcctttggcttctggtgagagaatctactcaagatatggatatcttccgtttttacaaagccgatctttggatgtaatccagccagatgtagctaattgtggtggaatctcagaggcaaaaaaaatatgtgatatggcacaaatttatgacgtattagttcaaatgcatgtttgtggaggaccaatttccaatgcagctgcgcttcaaatagaagcagtaattccaaatttctgcattcatgaatatcatgttgggaatatgtctgactttactagaagcttaggagcatatgatgatacaccagttgatggatatattactatatctgaccgtcctggaattggacaagatattcctgaagaaattctaaataaatgtacaaaatttatagctgattagcaggtaatcaacatatatttagagcattgtagagaaataacgattttattgaaaaaagtataggtttgaaaatttagataagcggttaataattttgccaatgtgatgagttattaaccgcttattattatttggtctatcattaaatattgagaattctataagaattatgctatataaggtattgtattttaaattaactagtgattttaaccacaataccttacttttattgaacttaaaattatagaattttcaagaattgagagaaaaactttattaactttaagactattaatgtatagtaatggaaagttgaagaaaatatcaaaaattgaatattgaggtgttactttttgataggattaatttgtttatatatgtgctcatataaatgaatcatttatcctattgaataaagactatattatattttgtttaagcccatactataatgaaggtgtagagttcatgaattaagaaatgcatgtgaatgcattaatgcaatttataatgacaaaagaactacaatggtagttagtactcaaaataagggagcaatagctggcttaccatatgatagtatcgtggaaatatcctctataataagtggaaaaggagctatgccacttaactggggaaaatttaattcagcagaaagaggcagggtgtatttttaaattacaatagtataatctcttaagaataagtgtaagcaaattagtataagaatagttcaaaagcttatagagtgtaaataaaatttatatttaggatttaaataaggtaattgagcagtattggaatttttaaataatgaaattcggtgcgttcatttgtacttgttggcccaaaattcaaacctgcaaaaatataacactaagcgaaaattataaacaacatgttttttatatattaataaagttattaaagtaaaggcccatgaacagatggaaaatgtgattatgtgcttttttatggtttttaaataatggattaggagatggaagaaggctgggatgaggagggaggaaaaagttttttggaattaaccaatctattaatatttataatatcgataacaaacgttcaagttttaacttaatggggaaaattaatgtatcatagtattcaaagaatatactcaaaacaatatttgagaataactaagcaattaatggcgagtaaatagacgaatttaagtatagaattatttatgaaaggcaatgatacgtatcatttataagagcaataaattatgataatttactatgaaaggaagtgaaaaactgacttcaaactttaaggtttaataagctatgaaagtcgggaatggttatggagaatatatgtaataaaaagaaattaaaggttgctattataggatgtggaggtattgcaaacggaaagcatttaccagcaataaaaaagaatcaaaatatagaaatagaagcattttgtgatttgatagaggaaaaggctatagaagcaaaagctaaatatggcaaagaagaaagtaggatttatactgactacaaacttcttttagcaaaagaaaaagatattaaggccgtttacgtcttaactccaaataaatcacacagctatatatctattgaagcaatgaaagctgataagcatgttatgtgtgaaaaaccaatggctaaaacatacgctgaagctaaagctatgcttgaagtagcgcaagaaactggcaaaatcctaactataggttatcaaaatagatacagagcagattcaaaatatttaaaagctgcatgcgaaaatggtgatttaggtgagatttattatgcaaaaggacatgcaataagacgtagagctgttccaacttggggagtatttttaaatgaagatgaacaaggtggaggtccattaatcgatataggtactcacgctcttgatttaacactttggatgatgaataattatgaaccagagtgtgtactaggatctgtataccacaagttaggggatcaaacatgtacaggaaatgcttggggcgattgggataaagagatgtttacagtagaggattcagcttttggatttattaagatgaaaaatggcgctacaataaatctagaatcaagctgggcactaaatagtcttgatgttgatgaagctaaaacttctttatgtggtacaaaagctggtgctgatatgaaagatggtttgaggataaattctgttaagtataataaacaatgtatagaaaagcctgcaatagatgctactggggttgctttttatgatggagaagaagataatgctcctgatatagaacaaagtacgttctataatgcaattattaatggtgatgaattagtggttaggcctgaacaagctttaatagttactcaaatattagaagcaatatatgagtctgctaaaactggtaaggctgtatattttaaataattaataatattatattttatggagatgaatttatatgaaattaggtgtatttaatccagttttacaagatagatcttttgaagatgcttgttcttttttggcaagtaaaggtgtacaaacaattgaaatcggttgcggaggttatccagggaaacaccattgtgacccagtaattttattaaaagatgaagaaaagtttgccgaatttaaatctattttagaaagaagcggtttagaaatcagtggatttagttgtcatggcaatccaattcatccaaataaggaaatagcaaaaaaattcgatgatgatttgactaatgcaattttaatgtgcgaaaaaatgggagtaagaatattaaactgtttctctggctgtcctggtgacagtgaaacttcccaaaaaccaaattgggttacttgcccatggccagaggattttattgaaatattagattatcaatggaataaagttttaattccttactggaaggaaaaagtgaaatttgcaaaggctcatggcgtagataaaatagctattgaaatgcatcctggtttttgtgtatataatcctaaaagtttattaagattgcgcgaagctgtaggaccagaaattggtgctaattttgatccaagccacttaatttggcaaggagttagtccagtggcagcaattagggagctcggaaagcataatgccattttccactttcatgcaaaggatacaaagatggatgaaatcaattgtccaataaacggtgtgctagatgtaggccactacggtaaggaaattgaacgttcttggatttttcgctctgtcggctatggacatgatgttggctattggaagaacattgtttctgcattgagaatggttgggtatgatcatgcgttgagtatagaacatgaggatagtttgatgacaacagaagaagggttgataaaagcaataaattgtttaaaggatgcaattatttttgaagctaaaggtgatatgttttgggcataattataaaaatttaatagggagaaataaaacaatgtgtaatgagatgttaaatttagcaatagttggattgggaggcatgggaaattggcatcgtgagctaattgaaggaattgataatttgactgtttgcggtacttatgatattaaagaagatagacaagcgtttgctagagagcatggaataaatccgtataattcttttaaagagcttttagaagatgagaaagtagatattgttttatgtgcaacaccaaatgatgtacataaagagatagtaatcagttcattaaaagctggcaaaaatgtaatttgtgagaaaccagcagcaatgtcatctttagaatttaagaagatggtagatatagcagaaggaatggataaagttttggttgttcatcaaaatagacgttgggatgaggattttttaactgtaaaaaggatatatgatgaagctatcttaggaaatgtctttagaatagagtccagagtacatggatctcgtggcataccaggtgattggagacaagaagaagaacatggtggtggaatgcttttagattggggtgttcacattattgaccaggcatgcatgatgattaatgaaaggataaaatcagtatatgctagatttactcatgttaccaatgaacttgtggatgatggatttactgctgagttagaatttgaaagcggattaatttacgttgtagaagttggaacaagtaattttataaatttaccgcgctggtatgtgttaggtcaaaatggcacagctgtaatagatgattggaatttaagaggcaaagtcgttcgtattactgatagcagtaaaaatgatgcaattcctattagaacagctgccggattaacaaaaactatggcgcctaggacagaggaaacaattaaagaagaagcacttaaaattgttaattctgatgttaaggacttttatagaaatgttatgggagctataagaggagaagaagaaattcttgtaaagaatacagaggtaatgagggttattaagcttatggagagtattcgtgaatcagttatcaagaagaaagtgatagagttatagaaattaatcaagaagcttaattgtaattattttggaggagatatttatgcatgggagttttgaaaaaacagtattagaatctgaatttccttttagattgttttttaatgatgggtattctaatacaccacatcactggcatgaagatatagaaattatttatcttgtggaaggtacactaaaggcatgtattaacagagatacttatgatttaacgcaaggtgacatacttataattggtggtggagaaatacattgtttttttaaagagaaaaaattcagtaatagagctgtaatacaatttagaacttccatatatgataattttctttctggaacgaaagatactaaaataataaaacctatgtggaatcaatcaatacatttaactatggggaatgaaattcacgcactaatggagaggcacataaatgagattatcaatgaatatagtaaggctgaggaaggatataagttaataataaaagctagattatatgatctggcaggtatactaattagatatatgcctaagcaatcatattcatctgaagacttaagccgtgaaaaggaaagattaaagaaaatggatagtgtatttcaatatgtagatactaattatcaagagcgtattgacttagatgacatttcaaagtccataggatttagtaaatattactttacaaaattttttaaagaaaatactggagtgacatttttagattatctaaataattatagaattaaaaaagcagagtggcgtataattgaggaagatgaaactattgcagagatagcctataactgtggatttaatagcattaaaacttttaataggctatttaaaaatatagtaggttgcacgcctatgaaatatagaagagataataaaaactaaatattaaattgagagggaaagggtatgggtgacagaaaaattgtaattaaaaaagatatagtaaatgcgctgcaacaacttggtgtaaaaaatggacaaaatattatagttcatacttcaatgaaaagttttggatttgtttgtggaggcccacagatcataattgaagcgttaatagagttagttggaaaagatggaaccataattatgcctacacagacgtggaaaaacatggacccagcatatggtgtacattgggaggaaccaatagagtggtgggatattataagagataattggccagcttatgataaggatattactccaacaaatacaatgggagcagtagcagaaatgtttagaaagtggtcaggtgttttaagaagtgatcatcctgtaaggtcttttgctgcatggggaaaaaatgcacaatatttaataaacaaccatgatttaagcgatattttcggagaaagttctccaattgggaaattatatgatttagatggatatgtattactattgggaactggatatgataaaaatacatctattcacttagcagatgaaagagctgattatccatcaaagcatatggagaaaaacagttgtgcaatgatgaaagatggcgagcgtaaatgggttacgtattcaacgctatatgttgatggtgaagagtttatagatataggaattgattttgagaaaaagtatagagttggaaatacaaaaatagggaatgcggacgtaagattcataagacaacgagaaattgtagattttgcagttgaatggattgaaaagaatagaaaataatcatataaagtaatattataatgagcaaattaaaaaaatcacgacaattaataatcaaatgtcgtgattttttttagttagaataatatgaattacaatttattatatgtttaattaaatattattttgctttcaataattatttaatatctaaaacaatttctccagctttaacattaccagttttcttaagggttattactttttcgtttaagttagttattataacgggcgttgccatttgaatttcttttgatttcatgaaagctaaatccacgtttaaaatagtctgtcctatcttaacgttatcgccctctttaactaataactcaaatccctcaccgtttaaagtaacagtatctaaccctatgtggattaaaacttctaagccgctatttgatgttagtgcaatagcatgtttggttttataaatcattgttattttgccatcaaaaggagcaacaactgtgccagttgatgggaatactacaaaaccatcacctaataatttttgtgcaaaagttgaatctggcgcttcagttatagcttttacttcccctgtcattacagatgccatttcgcttatagtctctggatcattattttttactgaagaaggactttctttgttcccctttacaacaaaaagatatgataaagcgaaggaaacgcttagggcgataagtatacctaacatagcatatataaagtatgggccaatataagctggtatactgaatacacttgatagaacgtatccatataaacgaactccaaagaagctaataaaagcagatgcaactgtacttccaattgttgcagctaagaaagcttttttgtatttacttagtattccaaataatgcaggttcagttataccaaaaagtccagaaataactgaagaaataactattgttttaccttgctttgtattttctttaaaataaacagccgctgctgctcctgtgattgaaatgtttgtcataaacatcataggcattaacatgtcataaccttgtgtagcaaagttttgaagagcaatcggtgtcatggcatgatgcattcctgttaatatagcaacaggacgaattgcgcctactataactccagcaagaattggagaaatactaaataaacttgcaataatccatgctaaccctcttcctaagtaaattccaattggtccagtaactcctaatgttaagaatccagaaataaataatgtcagagtaggtgtaaatactgtacgcatagtatcaggcatatgtttatcaattaatttgtgaacataacttaatacccagacagcaaagataataggaattacgctacttgaataattaaatactggtataggtaaaattccaaaaacataaaacgcgcctattttgccagccttagcagtatcaaccatggtaggatacatgattgttgcagcaatagcaactgataagtattcatttgttttaaatttctttgcggcagaaactgctaaaaagaatggtaaaaatgtaaatacaccgctggctatcatatcaatgaccttcatagtatcagtatcgccagctataaattttaaggcaactaatccagctattaatccctttatcattccagcgcctgcaatggcaggaactataggaccaaaaacacctgatactgtatccataaacctagttgttagactctttttatcatctaattgattattgctatctttatctgatgaattattattaatatttagatctagttgggtaattaagatattataatatttgtcaactgttgttccaataacaatttgaaattgttctttattaaattgtgaaccaacaattccttctagattttgtatagcttcttggttaacttttgttttatcttttaaatcaaaacgtaaccttgtcatacagtgccaagcatttttgatattatcttttccaccaacttcttttataatcttggctactacatcttcttttttcatattgattaatacctcctatggttattgttgttgccgtttacaaggcaataatatcataaaagaaaataaaataaaagtagaccaaaatgcggcattaaattctgtaatactagttataccaatgactataacgctaaatatataaaattggactggaaaataagaagaaaatgagttttttaaaagccaaattgactttagtattgcagacatgatttaatcttagtaaagaaaactttttagaaagttagaaagaaggtaatggagtggagcctacgataattacagatgttttatgttatataactaaaccagatagacataatttagtagtagtaaaagtagaaacaaataaagggatttacggcttaggatgtgccacatttcagcagagaccaaaagcagtaagtttagtagtatctgaatacctaaaacctattttaattggaagagatgcaaataacattgaagatttatggcaaatgatgatggttaattcctattggcgtaacggtcctattttgaataatgcaatttcaggcgttgatatggctctttgggacattaagggaaaattagctaatatgcctttatatcagctttttggaggtaaatcacgagatgcaattgctgcatatacgcatgctgtagcagataatttagaagatttatatactgaaattgatgaaattagaaaaaaaggataccaacatattcgatgtcagctagggttttatggtggtaattctagcgaatttcatactacagataatcctacacaaggaagttattttgatcaagatgagtacatgagaactacagtttctatgttttcaagtttaagggaaaagtatggatataagtttcatattttacacgatgttcatgaaaggctttttcctaaccaagctgttcaattcgcaaaagatgtagaaaaatacaaaccatactttattgaagatattcttccgcctgatcaaaatgaatggttaggtcaaataaggtcgcaaacatcgactcctcttgctactggtgaattatttaataatcctatggagtggaaatcattaatagcaaatcgccaagtggactttattcgttgccatgtttcacaaattggtggtattacaccagcgttgaagctaggatctttatgtgctgctttcggtgtgagaatagcatggcatacaccttcagatataactccaattggagtagcggttaatattcacttaaatattaatcttcataatgctgcaattcaagaaaatattgaaataaatgataatactagatgtgtattttcaggtataccagaagccaagaatggatttttttatcctattgaatcgcctggaattggagtagatattgatgaaaatgaaattataaagtatccagttgaatatcgtccacatgaatggactcagagccgtataccagatggcacaattgttacaccataaaaagcatgagggctaataccccatgcttttttgtcttttttcataattttctttgttaaaagggattatgtaagtacatgtgtaatctaaagctaggatattgctatattgataaattgttccatcacttagaattcctctattggtaatttccattgcaggagtgccttttttgcaatttagtagttctgactgattctttgaaataattgaagctttataatttgttatgtagtgagaaattatataactttttttttgaacatagtcttgaatagaaccttcaacatcttttggggttagatctggaaagagacagcatggaagtacggaggtttctaactgagtaatttgatactttacaatacgaagtcgttgaaattcccaaactaggtcattttcttctaatccaaaggtcttttgaatatctaatgagggggaaaccttttttaaataaattgttttagatacaatgtctttgtaagaattttcagtcattgagttgtaaattaggggattgctaagaatattttcttttatataaattccatctccctggatagtgtaaataagtcccatatccattagtcgtttcaaagcttcttgaatagtataacgcgacacttcatacttatcggctaaacttctttgtggtggaagttgattattaggaaattgatgttgatatattttacttatcaaatcttgcgctatgaattctctttttttcatgtactgcaatcctttcaattattattaatattattctagttaatcttttactattttgcaaatcaatatatttatgagatgcagtttgcttttagtaaggatattatactaattatttatagcaaaaattttcattaacaaagagaattaattactagattttaaaatattttaggagaattttttaccatatgtattgacttagagttaactctaaaatctataattaaattagtacattagcttataaataatttggagggacttaaagtggaaaaatcgaaagtatattttactaatatgcaagcaacagctaaggaaaatttgctacaaaagttaaaacgtttaattaagagtgcaggaattgatcaaattgattttgaaaagaaatatgcagcaattaagatccatttcggcgagccaggaaatgtagcgtttttgcgccctaattttgctaaagttgtggtagatactattaaggaattaggaggaaatccatttttaacagactgcaatactctatatgtaggaggcagaaagaatgcgttagatcatttaaattcagcatatgaaaatggatatagtccgttttcaacaggttgccatatattaattggagatggtttaaaaggaactgatgaagctttggttccagttactggtgggaaatatgtaaaagaagctaaaataggtcatgcgattatggatgcagatatattcatctcattaaatcattttaaaggacatgagttaacaggttttggaggcgctttaaaaaatataggtatgggatgcggttcgcgcgcaggaaaaatggaaatgcatagtagtggaaaacctagcgtttatgaagataaatgtgttggctgtggtatgtgtgctaaaaactgtgcacatagtgcaataagtttaacagacaaaaaagcactcatcaatcatagcaaatgtgttggatgtggtcgttgcataggaatttgtccaatggatgcggttatgccagcatcagatgaatcaaatgatattttaaataagaaaatagctgaatattcatgggcagtattaaatggaagaccaaattttcatatcagcttagtaattgatgtatcaccatattgtgattgtcatgcagaaaatgatgtaccgatagttccagatgtaggtatgtttgcatcctttgatccagtagcattagatgtagcctgtgcagacgcagtaaataagcagccagttatgaaaggtagccttcttgaaaagagcggttgtaagcacaatgatcactttactaatgttagtccagaaacagattggaaagttgctattgactatgctgtggaattaggcttaggcagtaaggaatatgagttgataacaatttagagataaacatatttctgaagttttaaaaattatatgttttaattttagtaagccacaaataaaaaaatataaatttatacctgcagagatgcaggtatttttgtttaataaattaaaaaatataaattaaatcaaatagaaaagcgttatatattttgtaatttagtttttgtagtgtaattttattaaaagagctaacgttctagaatgctaaatgtaaatttattacagttatgtatttagagttttgaataataagcattggattattaaatactaactttgtaaataattttaactgagatgaatggaggcaagtacaatgtttaaacacgaaaaaccattacttagagatgtaaaagtagagagaccaaatccacaatatgctgtattaatgcaagaacagctaggtggtgcaaatggcgagctaaaggcagcacttcagtacctttcacaaagttttagggtaaaagatcctgaaattcatgatttatttttagatattgcagctgaagaattaagtcatatggaaatggtagcacaaactataaatttactaaatggacatgaagttgattatactaaaactcctggaggagaaatagaaactcacgtattgacaggtcttgcaccaggacttattaatgcatcaggacatccttggactgcagattatgttaatgttacaggagacattgcagcagacttattatctgatatagcagctgagcaaagagcaaaggttgtatatgaatatttatatcgtcaaattaatgataaatacgtaaaagagacaatagattttctattaaacagagaggaagcacacaatgcactatttagagaagcattaaataaggtgcaggatagagcatcaaataaagattttggtgtaaccaaagattctagattatactttgacttatcaactcctggaaggtattttgacaatcctgagccaacacctcctagctttaaaaacccacgtgaaaatagtagggaaactactaggtcgtagtaaatataaagatcctatgccgaaattatgtattattaattttgcataggattattttattatattgaagtaaatggattatattaaaaaatccataagttgtattttgaaaaattaatatattgcgattaagcttataaattatattaataacgcagcttgtagcttaccagagacttaaatgtaaatttactatcacaacatatataggatagtagagttttataaaagcgtattaaataataatattattaagtaaatgacattacattttaaaataaaagttataaattatatggacaagtgcaataagtttgtggtagtctagagttgtaagtagtcgttaataataaggatagtattttgttgaaagaattttaataaagatataatagaaagtttgttggtaggaggataaaggaatgtattttaaagaaaagcatgggtttccagatgattttttatggggaagtgcatctgctgcataccaagtagaaggggctgcagaagaggatggaaaaggaagaagtaattgggatgagtttgtaagaatcccaggaaaaacattcaaaggaacaaatggtgatgtagctgttgatcattatcatcgatataaagaagatattgcattaatggcggaaatgggattaaaaacatatagattctctatatcttggccaagaatttatccgaaaggaaaaggtgaagttaatgagaagggattagaattttatgacaatgtaattgatgaatgtctaaaatatggaatagagccaatggttacaatatatcattgggatttacctatagctttacaggaagaatataatggttgggaaagtagaaacataattgatgattatgagaattatgctattactttgtttaagcgctataaagataaagtaaagtattggataacattaaacgaacaaaacatatttacaagtcttggatgggtaatggcagtgcatccaccaggaaagaagaatgatttaaagatgttctatcaagtaaatcatcatgcaaatttagctcatgcaaaagcagtgcttgcttttagaaaaatagtgccagatggtaagataggggcaagctttgcgttttcacctagctatgcaatagactgcaatccagtaaataatatagcaaaagcagattatgatgatttacaatcattttggtggatggatgtttatgcatacggaagatatccaaaagctgcattaaaatatctacaaggtcaaggggtagcacctgtatttgaagatggggatgcggaacttatgaaggcagcagctcaagtagattttatgggagttaattactaccaaacagcagttgttgagtataacccaattgatggcgttggaatggctgaaatgaatacaacaggaaaaaaaggatcagcacaagtcagtggaactcctggattatttaaaaatcctccaaacccatatttaaaaactacagactgggattggacaatagatcctatggggataagaatgtgctgtagaactattacaagtagatatgatttaccaatagttatttctgaaaatggattaggtgcatttgacaaaaagactgaggataataaaattcatgatgactatcgtatagcgtacttgaaggcacatatagaagaattaaaagaagctattaatgagggatcagaagtgattgcatattgtacatggtctataacagatttattaagttggttgaatggttatcaaaaaagatatggtttcatttacgtagatcgtgaagaagaagaaggcgcttcaatgaatcgttataagaaggatagctattattggtatgaaaatgtcataaagacaaatggagaagaattataaaatatgtaagtttatagataagcttaaaggagttgttgattttatcaataactcctttaaacttatctattttgttttataaattaatgttaaaaagaattagctgattaataaatttatataagattataaacactaaatttttaaaatagaatacaaaaatggaaaggaattagtaagattgtgtagaatttaataactatattttatttcaataatattattattgaaaaatagaaggaacttgaaaataaaaaataagaaatttgttgttaaagggaggggatttattgaagaatttaaagattagaacaaaattgatgttgatggtaataataccattgattgcggttatatttttgtctatagaaggaatactaaaaatcacaaatacttatggtacattaacagatatgtattatgaaaaattatataaggtaaatagcctcatactaaatgcagatagagatatgtatcaggctcttgttgctcagaataatttaagtgatacgaacataagtgaacctgataagaataagaatataaaagatttaaaagataacataggtcaggcaaaagatagaacaagcaatgctataaatatgttacttccaattaaggcatctttacaagatattaaacataatgaaagcaacaaaaatgtgtttgaactttatgatgaatttcaaagcaattatcaaggctggttagatagttttgatatagatacaggagaggtaaaaaataaggaacagtttaataaaaagtttgctgaatctagggaggatataaatcagataacagatgtaatggaaaaagcagcaagtgaaactcaggtcaacatgaaggaatctatagattttactaaaattcaatttgttgtgttgggaattttttctgttttaataactttgtttgttggaatagcaatatcaagagattcatcaaaagtgttatttaaaataaagaatttagcaactagactttcgaattacgatttttcagaggatttagttttaaagagatatgatgaatatggacaaacagcagatactttgaataaggcacagcaaaatgtacgtgaacttataagtgcaataactgaaaatatacataatgtaaattcgtccagtgaaaatttgactatatctgtaaatgaaataagtagtaatttaattgcagtaaatgaagaaacaaagaaaataaatacgagtgttcaagaaaatagcgcaattgcagaggagatatctgcatctgtagaagaagtaaacttgactgttaatatattatctgaaaaggcaatggatggaacaagtaatgtcacaaatataaaagcacgtgcaaataccgtagagaatagtagtaataaggcaattcaatctataagtaaagtatatcatgagaaggaagaaaagatcattaaagctattgaagaaggaaaggtagtgcatgagattgggattatggctaatgctatttctgcaatagctgagcaaataaacttgttatcattaaatgctgcaatagaagctgcgagggcaggagaacaaggaagaggatttgctgtagtggcagaagaggttagaaaacttgcagatcaatcttcagaagcagttgagaatgttaaaaaagttattgaaaaagtagaaaaatctttcaatgacctatctttaagtagtaatgaacttttacagtttatggatatggatgtaaataaacagtttgaggaattttcgcatataggaaagcagtattataaggatgcagacttcgtaaattccatgtcctccgaattagcaaggatgtctgaggaaattaatgaagtaataagtcaagtatcagatgcggttcaacatatggcccaaatgtctcaaagatcttctgagagcactaacagcatagaaaatagttcgagtaattcaatctcttctatgaagaatatttcagttaatgcaaaagaacagcttacactagcaaagaaattagaagagaccatagagaaatttaaaatatagtttctaggaactttagttatcaaatatgaagaaatagatgtacaattcatataaaagattttaattgcttgaagtgattattaaccatagatgaattgtacattaatttataatggggtagtaattagtgtttgatgaattagtgaagtgctccaatagctacttttttgtttagtaaggtttgtaaatgttttatattgaataaaattagtttagatttttaaataatccatgtattaagtcagcatttttgtattcatataacagaaagcaagttctatttcgacaataaagataacgctgataaatggattttaacttaaatttagcatgtttaacaaattaaatgaataatggaaaataaagatgccatatagtcaaaatatatagaatttatgttatataatatgtcaaaatatagttttcgattgttcaagattatggtattatagttataggttgtagattccaaatcattaagaaaaacgacagaaaatgtaattatatgttatattactaataaaaagataacatttaatcatatgacgtgcgaagaacaataaaggggacaaacatggatatatttttagtaattggtcttattggagggttagtaattgtagttgcagccatgctagaaaagggagcaagccttcaagtacttatgagtgcagaggccatactagtaatcattggtggtactgtaatagccttgctaaattcttttccaaaaggagagttcactaagcttcctaagatttttggtgttctttttagtgctaaggggcaagaagatcctgctgaaattatagcacaacttgtggagatgtctcagacaactagaagggatggattattatctcttgaaagtactatacaaggcttagaaaataagtttatgaaaaagggattagaaatggtggttgacggtttagaaccagatcttataaaagaagttctagaaatagagattgagagcatggaagagagacatcgtcttggtgctacagcgtttacaacagcaggtggtacagcaccaacgcttggagttttaggagctgttataggattaataggtgctcttggaaatcttaatgacattgaaaaacttggagaaagtataaaatcagcctttgttgcaactgtttatggtatttttactggatatttaatttggcatccatttgcaaataggttaaaaagaaaatctcaagaagaaataaaaaatatgaacattatgcttgaaggaattttagctattcaggcagggaataatccaaagagtattgaaagaaagctagtaggaatgcttgaaccaaaacaaagagtaagatttgaagaaaataataatgataattagttaaaaggagaaaagtgatgagtaagaaaaagcaacatcatgaagagcatgtagatgaagcatggcttcttccatattcagacatgttaacacttctgctagcactatttatcgttatgtttgccatgggacaaacagataaagcaaaatttcagtcaatggctaaagaatttaatatgatatttgccggagggactggtgttatgcatcaagatggtaactctgcaatttctatggaggaatctggtgttagtgataataaggctgaagaagacaaaatgactgaagttaaaaaaatgatagaagaggaaattaaaaaagaaggctattctgataaagttaaagttgatcttaatagtgagggattagcaatttctatacaagatgttgtactttttaattcaggtgaagcagatgtattaaaagatgtatcacaattgcttctaaaaatttcgcatatgctttatgggctagataatgaaatcaaagttgcagggtatactgataatgtgccaattaataatgggaagtttcgttccaattgggatttaagtgctatgcgtgctataaatgtgttgaattatatggttagtacaggaggtattaatcaggagaagatatcaatacaggcttatggagaacatatgcctaaggcatctaatgcaacagaggatggaagagctaaaaatagaagagtagaaatctttgtggtacgtaaatacccagtacctacagaggagaaatcaaattaactagataagagctaagagattaataagaaattttacatatagataattcagagcatttaatccatagagattgaatgctctttttatataaatttcaagatattttgtgcaatttgcatttatatgtagtatagtagtgcattttgcatcaaaatcaatgacttaagtgacttaaaagattgcaataaaaaacttaatatagaatatagagagattgacgttttatataatgaatatgtaaaaaaggagggaattaaaatgtcagaaagctttataaatgaatctatgttagatatgtatatatttgaaacgacccagcttatagaacaattagagcaattagtcattgatggagaaaaggaaaatggcttttcaaattcgatagatgaaatatttagaattatgcatacagtcaaaggatcatcagctatgatgctttttaataacatttctggactctctcattctgtggaagatttgttttattatattagagaaaacaagccagatgaagttgataacaatatattaagtgatattgtgttagattcaattgattttatcaaaggcgaaatttctaaaattcagcaaggaaatacaccagatggagattgcgcaaataaaattactggaataaaggattttctaaataaactcaaaggaacagaaacaattgatagtgatacaaagcctaatgaaaataatttgaagcagcaaaaattttttataaccagcgctaaaagtaaaagggacgtatctaatcaaaaatataaagctaaaattcagtttgcagaagattgtggaatggagaacataaggtgttttggtattcttcataaactatcagaagtagctgaaataatatgtagctcaccagaaaatataatagacgatgatgaaaaagcctgtgaagaaatcaggaagaatgggtttaaaatatatttttcttcagatttaaatctagaggatgtaaaaacaattctgaatgaaactgtttttttaagtgcacttgatattagcttaatggggaagacgatgacgcctttttagataataaagaagttgttgaagaagttgcgatagaaaaagaatgtagtaagaaggaagaagaaaagaaaactgaaaaaacatcctctcatcaaggatttataagtctaagtgtagctaaggcagataggcttatggatcttattggggagttagtaatttcggaatcaatggttacacaaaatccagatttaattggacttgaaattgataattttcaaaaatcagcaaggcaacttcggaaaattatagcagaaatgcaggatacagtaatgtcaataaggatggttccgctttctgcaacttttcaaaagatgaatagaatagtcagagatatgagcaagaaaatggataaggaagtcaaattaacgattataggggaagaaacagaagtagataaaaatataattgaacatatatcagaccctttaatgcatttagttcgtaattctattgatcatggaatagagacagtagaagaaagaattgataaaggaaaacagcaagtaggaaatttggtgttagaggctaaaaatgcaggtagcgatgtcctaattatagtaaaagatgatggaaagggtctaaatgaagaaaagatattagaaaaagcaagaaacaatggattacttactaaagatgaaagtgaaatgagtaaaaaagaaatatttaatttgatatttttaccgggattctccactaaagaagctgtatcagaatttagtggcagaggagtagggatggatgttgtagtaaaaaatattgaaaagatagggggaacggttagtatagatagtatgttggaatttggtacaagtatcaccattaagataccattaactcttgcaattatagacggaatgaatgtaagagttggaaattccagatacactcttccaactagctctataaaagaattttttagaccgaaagaaagtgatattataaaagatccagataataatgagattattatggttagaggtcaatgctatcctatacttagattaaacgagcatttttctataagaactgatacagataaattgtcagatggaattctaataatgatagagcaggatgaaaagtgggtatgcattttagtagatgagttattaggacaacaacaagtagttgttaaagctctcccagattatataaggaatattagaaatattaaggatttagctggatgtactcttttgggagatggaaatataagtttaataattgatatggatggattaatgacaacagtatagatattaaaaatttaagtttaattaaaataagtggttaatggagggaaagaatatgaggtggttaaacaatataaaggttggagcaaaattaataattgggtttatagtagtagctttattagctggaatagttggtgttataggaattacaaaaataaagaaaatagatcagaattatactaatttgtatacaaattatggggcatcaattgctgatgttgctagtgcatctatatcttttcagagacttaaaataaatttgaataatattacaatgtatagagatggaagagacatgagtgattatgttaataggataaaaaattacgatgtaaaaattcaagagagtttaaaaaagtttgaaggttcacttcaaagtgatgaagcaaaagctgagttttctaatcttaatacacttttaagtagatatgatgcaataaaggataaagttatagagttatctctttcaggcaagagagatgaagcgcttgagttaatagggcaggattcaacgcaaaaactatctgaccaaataaataattctgtagacaatctgttccaattaaaggaatcagcaggctttagtaaatcaaatgagtattccgcagaggttaataatgctgttgtgactatgatagttgtaatagtagtagctataattatagctatatcacttggaattattatttcaaaagctataagtaactctatagcgaagcttatgactgtaacaagtgaaattagtaaagggaacttagatgtagagattattaatgattcaaaagatgaaattggaatattatcagaatcaatgaaaagaatgaaatatagattaaatgaagtaattggtcagataggatttgcggcagagcaagttacagttggatctagacaaatagcagactcaactatagctttatcgcaaggggctacagagcaagcaagtgctgttgaagaattgacagcttctatcgaagaaatatcttctcaaatatcagtaaatgctgaaaatgctaaaaaggctaatattataacagatagtactaaaacaaatgcggggaaaagaaataatgaaatgaaattaatgcttaaggcaatggatgaaattaatgtctcttctaataatatatcaagaattatcaaggtgattgatgaaattgcatttcaaaccaatatacttgctttaaatgctgcggtagaagctgctagagcaggtcaatatgggaaaggctttactgtggtagctgaagaagttaggaacttagcagcaagatctgcaaaggcagctaaagaaactacagaaataatagaggaatcaattgttaaaatccaagatggaaccaatatagcaaatcaaactgcagatgcgctcgaaagtattgttagtgatatagaagaggttgcaaaaataattaatggtatatcagatgcatctgaagaacaagctacaggaatttcacaaatatcacaaggaataatacagatatcacaagttgtacaaagtaattcagcgacttcagaagaaagcgcagctgcaagtgaggaactagcaggacaggcagaagttttaaaggaacaagttcaaatgtttaaattagcaagtgctagaagttcaatgactagctcggacaatagctatatgaacaatagtattcatgatgatattagcaaaaacacaagagatttaagggaaacaagagataaacatttagatagaaaagtatcaaattctaaaaaaataatacttagcgataatgaatttggaaaatattagagataaggtgattatatgatttcaattacggaaaaagaatttgctcaattatccaactatataaaagagaactatgggattaatctcagggaagaaaaaaaaatgttggtaattggaaggctccataatgtgttagcagagcataatatagaagatttttctcaatattatcaatatgtagtttctgataagagtggaaaggcagttagtacactgctcaataaaattacaacaaatcatacatattttatgcgtgagaaaacacattttgactacttgaaggagaaagtacttccttatttgattaattcagtaagagacaaagatttaagaatatggtcagcaggatgttcctctggagaagaggcatataccattgccatgatattaagcgaattctttaaacaagaaaagttatggtgggataaaaaaatactagccacagatatatccgaaaaggtattaagcattgctaaaaatggaatatatcataaagaacaaatcgcaccattaccagagatgtggaagaagatttatttaaaaaaatacgatgatgaaaatttcgtattttcagagaatattaaaaatgaaattatatatagaaaatttaatttaatggaagatgtatttccgtttaagaaaaagttccatgttattttctgtagaaatgtaatgatttattttgataatagaacaaagaatgagctaatccgtaaattttataacagcatggagtacggtggatatctttttatagggcattcggaatcactaagtggtgataccgctgggtttaagtatataatgccatctgtatatagaaaggaatagggttatcttaagataatttaaagggctaagaaggtgaagttaatgagatcaattagagttttaatagttgatgacagtatagtatttagggaagcaatatcgagaggaatatcaacggcacccaatatagaagttgttggaaaagcggtagatccatatgatgctagagataaactattagaattaaatcctgatgttatgatttgtgatgtacaaatgccaaaattaaatggtgtagaatttattaaaaggcttcttcctcaatataaaattccaataatagttgtaagttctataagcgatgtagtcttcgatgctatggatgcaggagcagtagactttttaagtaagcctgatgctagaactcctaatggatttgaaatttttattaacgagttaataattaaaattagaggcgcggtaaatgtaaatctatctgctaatttatggcaagttccaaagagtggtagtaataggggaatggaaaagagcgtaaatgttagaaataaagtgattgctataggagcatctactggaggaacagaagctatctataacctattaaaaaatcttcccaaagatattccggggataattatagtacaacatataccaccagtattttctaagatgtttgcagatagattgaatttgcaaacgcattttactgttaaagaagctcagactggagatactattgagccaggtaaggttttgatagcaccaggagatcaacatatgaaacttaagaaggctgcggataagtacattgtagaaactattcaaggtaataaagttaatggacattgtccatctgtagatgtgcttttcgaatctgtggctaaggtggcgtcaaaaaatgctataggagttattctaacaggaatggggcatgatggagcagtagggcttatgtcaatgcgaagagcaggggcaagaactatagggcaggatcagaaatcctctgttgtatatggtatgccaaaagttgcttttgaaattggagccgttgaaaagcaagtggctatttcaaatatacctagtgttatttgcgatatgttaaaataaaaatggactatttatactagtccattttttacagcataaactgcaagttgagtacgatctctcaaactaagctttgaaattatttctgtaataatatttttaacagtaccttcagcaataaataaagatgatgcaatttctttattatcttttccatcaacaatcatagatactatttttagttctctttcagttaatgagatatttatgccattaatatcaataatttttttcttagcttttttattttctttacgcagatttaatatcataggacttaagatatctttagtaattatgccaagtcctagtgatatgctttttatagatagtataagttcctcagtacttatatcttttaagatatatccgtcagcaccattacttatagcatctgtgacatcagatttatcattagatgcagttaaaactagtaccttaactgatggaagttctgcttttattagttttgtagcttccgtaccattacatataggcatagacagatccattaaaacaacatcaggcatatattctttacatagatcataagcttcatttccattagtagcgcaagctacaacttttatatcactgttattttcaattatgtttttaaaactttctcgtaaaagtttctggtcttctgcaataattactcttgtcatatacgaaccctctctttacccaaataagcaatatattaaattttcgtgaaaaatagacaaataatatttattaaatctaatgaaaacacagattaaccgcttgtagattctaatataaattataacattttacaaatacatgaacaatgtataaagctaatcttaattaaactaataaaattttgtgtgtaaactttattagtttaatttttaaattgcaattgtaaatattaggggactattgatggtgaaaatccttataaatgtcatctatatgaagtggattttaaataaaaatgcaatcggcatatttatacaaattaattgtgcaatttgcatgatactacatgacttgtggtactacaaaccaattttaaaaacatttaaaataaaattaaaggaaaagtggtatttttatagcatttcatgggggtgaaattatatgaaaagagttttagtagtagatgatgcggaatttatgagactcgctttaaaatctattttacaaaattgcggatttgagatcataggtgaagctgatactggtataaaggccgtaaaactatataatttattaaaaccagatattgtgacaatggatttgaccatgccagaacttggggaatagaagcaataaagatcattaagtcaatagatgaaaatgcaaagattatagtaatttcgtcattatcgcatgaaatccaagttaaggaggctatgctagcaggagctatatcttttatagtaaaacctttcagggaggacattgtatctaaacaactattaaatattgaaagaaatattagaaaataaaactttaagataagcatgtaattgaaagcattaggaaattaacttgaaatttaagataacatcataagagtaaattttgttagatgggatggattaagatgtttgaggtaagtaatctgaaaataaaaaataaaattgggttaatatttacaggtattatagctatggaaattgctttgtttgccgcatttaatatcggagtgggaaacgtggcagatataaaagaaatgcgaattaatatgataataatattactgttttctataataatcacagtaatcatgggattattactaataaatttcatctacaaacatataagaaaaattaataatattgcaaggaaaattgctaacggagaatttgacgaagatatacagatagattttattgatgaattcggggatctagctaattcacttaaacagatacaaaaaaatataaataatttgatcgatgattctaatttaattgaagattgcattaaaaaaggtaattttgatatagctttagatttatcaaaatactcaggggcatggggaaatgtacataggaagagtttagcaacaatgaatatgtttataaagaatattagagcaacttcacattacatagaaaagataagtaagggagaatttagtgagaaatacactagggaggaaataggatcatttgatgtaataaaaacaagtattaatcaacttatagataatctcaataatctgatggagaatattcattggttcaaagaaagttttagattagggaatacaagagataaaatagatgctacaaaatttcaaggttcttataaagaaatggtggaatgtattaatgatactacatggatatcgatagaagtatttattaagttatttgcagtgcttaaatcatattcaaaaggagattttacagttgagcttgaaaaattcccaggaaggtatggattagtaaatgagcatatagaggacttaagaaataatttattaaatatatctaaggaacagattaacatagccaatgaaattaaatcaggaaatttagcaaaaaggatagattcatccaagtttaatggatcatgggctaaaatgattgatggaattaatgatgtaattgatgcgtttgttgaacctattaatattacagctgattatgtgaaaaggataagcaatggggatgtaccagaaaagattaaaaatgagtaccaaggtgaatttaataaaataaagaacaatttgaatacattaattgatacgttaaatttatttgttaaagaagtcaattggatgaatgatacatttaaattaggtaatacaagagatagaatagatgtttcaaaattcgatggggtatataggcaaatggctcaaagcgttaatgatggaatgtggatatctattgatgtattaataaagatatttgcagtattaaaatcttattcagaaggagatttctcagttgagcttgaaaaattgcctggaagatacggaattgcaaatgaaagtctgcatggattaaaatctaatattcttaaagttcttgatgaacaaataatggttctttcagcagcggctgaaggaaatttagagattagaggtgaaagtgaaaaatatacaggtagctttaaagaactcataagtataataaacaaagctgttgatgcttttgctaagccaataggagaaataaaaaatgttttagaagagatgtcaaaaggtaatctcaatgttcgcattgagaattcttataaaggtgattatggaaatataatgaacgctttaaatttatctgtacaagaaattaatcaagtacttactgatataaatatatcagcaaatgaggtggcttcggcatcagtacaagtctcaaatgcaagccaaaacctatcgcaagcatctgcggaacaagcaagtgccgtggaggaagtaactgcttcgctttcagagataggagaacaaacaaaattaaatgctataagtgctaatgaagctaatgagctggctacaaaagcaacaacgaatgctattaatggaaatacagaaatgaatactatgctaaaggctatgaatgagattaatgaagcatctgaaaatatttctaaaataataaaagttatagatgaaatagctttccaaactaatatattagctcttaacgcagcggtagaagccgcaagggcaggacagcatgggaagggatttgcggtagttgctgaggaggttagaaatcttgcaggtagaagtgcaaatgcagctaaagaaacaaccgctttgatagaaggatcaataagaaaagtgaattcgggaactcaaatagctaacaatacagcagaatcactaaattcaatagttaacgatattagtagcacttctgagatagtaagaaaaatagcagcatcttctaacgaacaggcaactgcagtatcacaaataaatgaagcgattgaacaaatatcgagagttactcagataaattctgcgacatccgaagaaactgcctcttcgagtgaagaaatgtctagtcaggcagaaactttgaaacaaagggttgctcaattcaatttaaaaaagagaagtgcaaataaaatatttttagacagcatagaagaaaaggaagcatcaaggctagaaaatgccatagatgagagaagatttggacaagtatctaacataagaaaaaaaattagtattaatttagatgacacagagtttggaaagtattagtattgatttctagtagaagagaggaagtgttagcatgaatacaaatataattaatgataatgcagatatggaagaagatactcagaagggcaaataccttacatttatacttgatgatgaatcttatggtataggaattaataatgtcacagagattattggaatacaacctataactttagttccagaacttccagattatataagaggaattattaatttaagaggaaagataattcctgtaatggatgtgagattaagatttaagaaggattttagggagtataatgatagaacttgtataatagtaatagatattaatgatttatcaataggtcttattgttgatagcgtttctgaggttctgataataccagaccaagatattgtaccgccacctaatctaagcaaggttagcaataagtatataaagggaataggaaaaatagataatcaagttaaattaattttagattgtaataagttaataaatgatgaggatgctgaaaccctaaataacattgaacaatagagggaggacattattatgaaatggttcaaaaacatgaagataggtttgaaaatacttttgggatttttatttgcagcctttattgcaggcattacgggtatttattgtatttcaaatataaataaaattaatgacctagatactaaattatataataaaatgactcaaccattgggagatgttattgaggtttcgaatgattttaataatataagagctaatactagagatattttgctttcagataatacaggagaaattcaagattatattagtcaaattaaggacaatagcgataagtttgattatagcttaaataaattgtcagagacaacattgactattgaaggaaaaaaagctattgaggatataaaggtttctaaatcagaatatatgaatcttataagcaaaataactcaactaaagaatcaaaatagaaatcaagaagcaattaataatttatattcagaaggaaagcctattctagaaaagttacagtcaaatttaaaaacatatacagatttaaaactaaagatagctaaagaaacttcggatggtaatagtaaaacagcagataacacaacattattaacagcaataatcttaattataggagtgattttatcaatactaacaggagtatttatctctttatctataagtagaccagttaataagataataagaatagcagataaaattgcagatggagacttcaatataagtgttaatatagagagcaaagatgagatcggattattggctctttcttttagaagaatggctgaaaaattaaataatactatctgcaatataaattcagcaacagaacaagtttcagcaggggcaaaacaagtttctgattcaagtgtagcactttcagaaggggctatggaacaggctagctccattgaagaattaacagcatctattgaagagatatctgcccaaacaaaaatgaatgcagagaactccacaaatgctaatgaaattgctgttagtgcaaaaataaatgctcaagaaggctatgagcaaatgaaagcaatgaaaatagcggtagaagatataaataatgcttcaacaagtatatataagattataaaagttattgatgaaattgcatttcaaactaatattttagctttaaatgcggcggttgaagcggcaagggctggacagcatggaaaaggttttgcagtggttgcagaggaagttagaaacctggcagcaagatctgcaaaagctgcaaaggaaactgcagagatgattgagggcgctattagaaaggcagaaatgggaactaagatagcaaaacagacatctgaagcactaaataaaattgtagaagatactgtgaaggttgctgaattcataaatcaaatagcagtagcttcaaatgaacaggcagaaggaatatctcaaattaatcaaggagttattcagatatcagcagtagtgcaaactaattcagcgacagcagaagaaagtgcatctgcaagcgaagagttggcatctcaagcagagatgttgaaagatcaagtttcaaaatttaaattaagggaaactaaaagctgtttagtaaataattcaattaaaaacatagattttgatatgatgtaaaaatatgaatgatttaaaattagtgccatggagtgaagcctatgataaatgatattagagttttgataatagaagattcaaaagcctctttgaattttgaggtagcacaacttaaaagaagtggtttcaatgtagactatgagcaaatagaaaatgcagaagatttaagaaaggcgttaaattgtaaggagtgggacataattttatctgatcatgtaatgccaaattttaattctattgaagcattgaaaatattaaatgaaacaaagttagatataccatttattatagtatcaggtgaaattggggaggagacagctgttgaagccatgcgtgctggatgcaaggattatatcatgaaggataaaatggcacgtcttggaatggtcgtaaaaagagaacttaaggatttgcatgaaagagttgagagaaaaagagtagaggaagagatgagaaatcttcttataagctcaaaggaagaagcagaagcagcaaataaagcaaaaagtaatttccttgcaaatatgagtcatgagataaggacgccacttaatggtgttatagggatgattgagcttacattaatgaatagtgagttaaaagatgaattgagagaaaatcttctaattgcaaaagatagtgcttattcattgattaatattgtgaatgcgatactgaatttttcaaaatcagaagcaggaaaaatggaattgagggaatcgaattttaatcttaaaaatctaatacataacacacttaaaatctattcatacgatgtaagaaaaaaaggaattactttagaatataatgattcagatgaaattccggatttattgtatggagattctgaaaagttacaacaaatacttaacaatttgataagtaatgcaataaaattcacagatggaggaagaatttcattaataattaaggctgagcaaataataggagaaaagattattttaaggtttttagttaaagataccgggataggaattaatgaagaagataagaatttattatttaaaagttttagtcaattaaataattcttattcccgtgaatataatggaactggattaggacttgcattgtcaaaacaattggttgaaatattagggggagggatttgcgttgaaagtcatatgggactaggaagcacctttagttttacagcggctttcagactagtaaagagaggaaaagtgaatattaattcatatgaattacaagagaaaagaaatttcgaaaattcgaatgaaataaatagaagcacagatttaaacacagaattaagaagattagttgaaaaaatggacgaggcaaataataatctaatcaaaattgaaaagatagcagagattataaataactctatagttatttctaaatttgatgaactagtgatgatgggatttaagttgaaagcaaatgcacgaaggggaaatgaggaaaaagtaaaagtgacttttgagcaattgagagaacgcattattagtctaatgcatatataaaatttgggtggaaaagaggttggtatatgagaattcttattgcggaagatgattatgtaaatagacggtttttatttaagtttttttcacaatatggtgattgcgatatggtagttaacggagaggaagctgtccaggcatttatgttttcagtggaggagaaagatccatatgatgttgtatgtcttgacataatgatgccaaagttagatgggttaaaagcactgaagatgattaattcaattgagaaagaaaaacaaataacctatgaaaatttgtctaaaaagtttgtgattacggccttagataatgcaaaagatgtccaaaatgcttttgaactagggtgtgaagtgtatgtaactaagccaataaatactgataaattaatcgaagttatgaagaaattaaatttagatatagatgataaaaaataatttaaattatataaatatctggtataggcaagggtgttttaaattgtattcgtacagaagatatctttatataaagaaagcaacttattaaaagtaatttatgagagggtgttttattatgaatttaaattgggacaataatttagcaacggggattgtaaatatcgacaatcaacacaaagaactatttgatcgtattaataaactattgattgccatgaaagaaggaaagggtaaggatgaggttataggaactttaaacttccttgaagattatgttataaagcattttactgaggaagaagaaattcaaaagaaaaataattatcctaaatatagcattcaacataaacagcatgaagagtttaaagaagaacttaaagaattgagaaggacatttgaaactactggaacatctgcattatttgtgataaaggtacaaaatagaatgtcaacttggtggaagagtcatatacgagatctagataaggatttaggaaaatttttaatagaaaattctaaataatattaagatattttggataaggggatacatatatgagaagttgggttgtaaatttaaatttgaagtttgtaaataaatataatgttccattcaatagttttgttattaaggcagaagaaaaggaagaatttctagtaaaaatggatagggtattaataaaggttatggagttagtcaaatttgaaattgatgatatatcaccatttgattacagagaattaccagaagaaattgttaatgaatatatttgtgtagattaattatgctaaacatttaaaatcttagggtgaggattatatatagataatgatattttggtatagaagtataaattatgagagggtgtatgaaatatgtatgaagtattgaaaaaggatgaaagaggattaataaataataaaatagcgtcatcaatggtaaagtttactcatgaagataatgattcggttattatggatattagcagaatcaatattagtggtgaggtacttatgcattttatgaattcaaattgggatgctgtgttatccactggagttgataatatcgatagacagcatcaagaattatttagattaattaataatttggtaagtgctatgaatgaagaaaaaagcaaggtagagattattaaggcgttggattctcttgaagaacatgcaattcgtcatattaatgaagaagaagcaattcaaaaggaaaataattatccaggattagagattcagcagatgcagcatgaagaattcaaagagtgcttaagggacataagaagcttcttagaaactagagaaatatcaacattatttattatacatatgcagcaaaaaatatttaaatggtgtagaaaacatatgctaaacgcagataaagatttaggagaatttctaataagtagtcgtagaaattagatgataatttaaaaagatagtactaagaattaaaataaaacctatgaaatagacactcagaaaagagatatttcataggtttagtttaaataataattctttagtgctgtcttttttattatatagttatatgattatagacatctcataaaagaagcttctgattttttttaaggctatggagatgacagtaagtatattacttaaatgcggttggatattattataattgctatttttcaataaattattaatttgggtagtttcctcatagacatcagttattctataatttccggaaagccccttcaagttatgaattattttttgaatattttctaaatcactttccatcatggaggcctttaaatctgataatgctatattaaattcattaatcaattcggcataaagctcagatacctgttgaagattaagtcctaaatcatttgaaaaaccaattatgtcataatctttgtcataattcataaattagataacgcctctttcttaaatatagtattatgtcttattaatcgatgtcttctttgttaattttagctaatatgatgcacaccttttcgataaagtttggaatatcaattggtttagtaatataatcagaaaatcctaatgataatcctttttctatatctctaggcattgcatgggcactaacagctatgattggaatatctttagtctctttatgcattttgagtcttttgaagacttcataaccgtctattccaggtaaatttatatctagtaatataatatctggcttatgggcaatggctaaatctaaacacagctcgccagaatttgctgaaagcatttttaaattactaatttgggatagagcacgttcaacaagtcgtaaattagcaggattatcttcagcatataatattgtacgaaatttatcgttagggaaataagttctattttcagatgtcatcatattttcagaagtttgcaaaatagatgattcgatgcaaggaagttcaatccaaaagtgactgccagcacctttttcgctagttacaaatatttcaccattcattaattcagtcagttgtttagcgactgcaagcccaataccagtaccctcaattgaattattaattctgtttagacgataaaatggtttgaaaatcaattctaaatcagaattggataagccaattccagtgtcaataacatgaaatctatacttatcattaaccttatcatgataaaagattacttggccatcttttttgttgtacttaattgcgttagatagcaaattgagcaaaatttgttttaatcgtgtatggtcagccgaaacaaattcatctgaattatctataggataattaataatttttattttatgtttatccgcaaatggttttattatggaaatagcctcttctattacatgtttaatcggaacagattcaattgaaatgctaagttttcctgattcgatttttgctaaatctaatatttcgttaatcaactccagtaagtgactgccagctttggatatttccttaacactctgactctgagaaggatttaatggagattcagggtctaattctaaaatttgagaaaatcctaatatagcatttaatggtgttctaagctcatgactcatgctagataaaaattcggattttgctttactagctttttcagcctcttcttttgcagtaataatagaacgagccattttcttttgttctgtaatatcacgagttagaactactactctatctttatagtttagatgaggagagatacatgcctcaaaccattttaatccatctttggattggatattaaaatccatagtagtagattttcttgatttaatgacataatgtatcttctctttagcaattttagctgtactttcatctaaaatatcatagatagaattaagatgaccgtgcatatgtagtttatacaaataagtatggacgctggaccataacttagtgatataaccgtttatatctatctctgagattatgtcattaattgaatcaacaagtgacctgaaatcaacttctttttttctgagttcagattgggtaactaataaatttttatttgtttcaccaatatgatgtcccatttctatcaaatttaatgctatatcttctaattctgagatctttaatagtggatcagctatatcatatttaccactactaatctcctgaacaatattattaatatttagcagagagccagaaacaatatggctcatattttttactttcttataagtaattaagaaaaataaaagatacgataaaattaatcctaatattgtaatgattccaattttcaataaattatttcttagcatatcagcattagagtatatattttttgttggaacaactattaataattttaaatctgtattagggatagcagaccaacatgcaattctaggttcttcttttagtgtgaaatttgaaaatccagtttcgctagtttgaatttcatccattaatgtggataaatcattattgttatacaagttatactgataatacccgtttccatattttaaaacgagttgatctaaattcaaatcactttttccaacatcagaaagtgaaagaatattaccatcttttccaatcaataagttataaccattccaaggaatatcaatttctaaaaccttattgacaattgaatccatatttatatcaatgcctacaacaccttctaagaaattgccgttataaacaggacatatagcagaacttataaaattgttgttacttgaattaaaatcatgagccacccattttactttttgatctggattatgattagcatcagcttcataataaaatttgctagaaggtatttgtagagaataattatagctattaaaaacatcaacgtatgggtaagttatatttaaggaatcaaaggtattaaaatatatggaattaactaatggacaagaattcttaatatctgccattaatttttgttgtgttaataccttggctattttcttttctttatcatctcttgtagcaggtagaaaattattataaaaaattgctgcctcatcagctgaattgttctctttagtataataaatattatcatttgaatatgataacctactatattctgtaggagttaaagaaactgtagttgataaagcatgtcccatttgcaaactgaaaaacattgtagaatttgaaatagatgataagtgctgatcaattaagttaacctcttgtttaataattttattaagttcactttttgattgatctttgtaaaaggcaaccgaacttttatgagaccagtaatttgagatgaaatatatacaaataaaaattatttcaataattattaatggaattaatgcattacgaatataggactgccaaatccatttataaagagaaaaatttttatgagtatttgctttattcataatatcacctcacccattatgcctagtaatcataaacactgtaaggtactcgtgattttggaaattatatcatcataattaaatggtttagtaatgaaatcagcagcacctttagccaacgctttatcatagtattccttatcgttttcagcagagatcataattatagatagtttattatcatcctttataagatttagttcatctataatttgaagtccatcaacaaatggcatcctaaagtctaatagtatcaaattaggtttatatgtagaatataatcttaaaatttctctagaatctgttaatgtttttatattcttataaccagatatgttaagcattctttcaagtagtaaaacattagcaatattatcatcaactatcaaaatttttgacattgatttatcgacattcataatttaatcccctctcaaaaaaacttaaaagtcaacacctaaatacttacaaaattaatacctactatgaataatataacatattttagaaaaaagtttaaccaaattttagttttttcttataattatttcagtagctaatattaaaataattatgagattaacaaatgaagttcaacaaataaaaaataagagaagtgatgaatatatacaaaaggaataaattacatatttaaaatatatacatactatatttagaagataagagattagaatatttatagtattcataagttaatatagtattcttataaaacttaagaaaggagaatcaaacatggtggcaaggtctagtacaagatatgatataattaaaactaagtaatcaatttttaatgtggtatttatcggagtaataaaactgaatgtgatattaaaaattatgatataaattaagtatgtacttgcaaataataatcaaatatatagaattatggtataatttagtatatttatatatgtatatgtagaaaggagataacaagagatgccatttataggatcaaaagttagtgtgaaaatttcaaaggaaaaagaggaaataataaagaaaaaattaggggaagcaataaaattgattccaggaaaaagtgaaacctttttgatggtaggcttcgaagatgattactcattatatttcggaggagaaaaattagaaaagggtgcatttatagaagtaaaaatatttggaaaatcaagtaaggatgcatatgatgctttaacagcagaaatttgtaacatatatgaaaaggaattagacatacatcaagataagatatatgtcaagtatgaggaagttgcaaattggggatggaatggaaagaatttttaaccacgactggtaattagatataggcgacctaaagtaaagggtactctgatgtaacaatgcacatagtatcctttatttataatattgaaggaggtacaacttgattataggaattgcacagatggatataatctgggagaatattaataaaaacatgaagaaagttgaagaattcattgaaagagcttcgaaaaataaggttgatttaatcctatttcctgagatggctttaacgggttttaccatgaatataaacaagcttgtattatctgaagatgaaataatcaaatggattgaaaaaaaggctaaggataataatataaatataggaattggtgttgcggtaaaaagtgataaaatggggagcaataaatatattattatgtcaagagaaggtaaatgcttaactaaatatacgaaaatacatccattttcctacagtggtgaggctgataaatatcataaaggagataagatactcacatgtgagattgatggattaaaaatagttccatttatttgctatgatctaaggtttccagaaatatttcaaatagcatctaaagaagcgcaaataataactatagcggctaattggcctaaagaaagagagaagcattggataactttattgaaagctagggctatagaaaaccaatgctatataatagggataaatagagtaggaattggaaatgatcttcattataatggaaaatcagtttttataagtccagatggtaatatattgaacgaggtaattgagaaagaaacactaattataaaagagttaaaaatagatatgataagagcgattaaagaacagtttgatataaagaaggatagaagagaagatttatataaggctataagtaattgtaattctatttaacattaaagtaatgaatggtaggtaaagctatgataaatgattttcaagaagaaattgaatatagaaagctcgcattaaaaaatgatattaaaaaaagtggcggaaactgtgcaaggatacttcttgcgttagtattatcaacatatggattagtgttcataatgacattttctataaaatttataggaccaatgataggattcaatgtagtaactaatctaaaggaaaatataattttaggactttcaagtgacgcatataatttttttgctggatattttacatgtatagttggggatcttatagcaattctaatagcaataaaaactataaaggtgaaatttaggcaagaaatattttcaaagaataagtcaaataaaatgtttgtattattaggagcaacttcttgtataggggtaggaatgatttcaagcatggtatatatgatatactcaacaatttttaagattttaggattaaacattccacagccagattttagtttccctaaacaaaacacttttttaatattatttttaatatatgtatgtttagtgggaccaattttagaagaaattatatttaggggatttatactcagaagtatgcagaagtatgggaatctaacagcaatgattgtttcgtcaattcttttttccatgtttcatctaaacctagttcaattcatcaatccaatacttatgggaattgttttagcatttattgcaattaaatcaaaatctattataccgtcgatgatagctcatatatttaataatacgataacttttgctacaacaggaatatctttattaaagatgcctatattggagtatacatttggaactttgtactttttagttggggtagctgcattattgctatttattagtaagtataaaagcgaatttttagaaatagtaaaagaggatacaagaatattaaagactcaccagaaagtacgatattcttttagtggagcgtggtcgagggcttatatagtattctatataatatttattgttgtaactatggcagcaactaatttagcaaagtgatctattataaagggcaaaaggttgttttatggagtgataaatattatgtcttaaactaaagatattagtgtggatagaagtcgaaattgtatattgacactatgaaaatggatgcctataatttaagcatcaattaaggcatagtaggtatgttgtaaaacattattttatctgtctatctaatatcatgcagaagttagtaagtcatattgcatcattaaagaataatataattctaggcagtatatatactgcattgatacaaattctattttatgaattaaaagggggattaatatgacaaataaaatattgttatctataatagagaatttaaatgatgagcttatagaagtatatcgcaaactacatgagaatcctgaattgtctaatgaggaatataaaactacacaactgataaaagatttgctaaaaagagcagatatagatattcttgatttacctttggatacaggccttgtagcacaggtaaaaggaaatcctaatggtcctgtcgtcgctatcagatgtgatatagatgcattaccaatcaaagaagagacaagtctctgttataagtctaaagttgatggtatgatgcatgcttgtggtcatgattttcatatggcggtgattttaggtgcagcatatttagttaaaaagcatcaagggtcattaataggaacagtaaaatttatatttcagccgggtgaagaaagtgcggatggagctaaaaaaattttagagacaggtgttttagatgatgtggatgcaatttttggaatacacaatgtttcagattcagaagttggaataatgggaataaaaactggagcaatgacagctgctgtcgataggtttgaaataaatattgcagggattggtagccatgctgctaagccggaaaaaggaatagatccaattataattgccagtaacatagttacatcacttcaaacaattatcagtcgtaatataggtccaacagaaaaagcgctattaagtgtgactcatatagaaggaggaaatacttggaatgtaattccagaatcagcatatcttgaaggcacagtaagaacattagatgagaatatacgtcaattaatagctaagagaatgaatgaaatggtatcaggaatagcacaatcttttggtggaagtgcagagcttatttggcattcaggttctccggcaacaaataatactgaagaatgggtagagtttagcactaaaattggaaaacgatctggatatgatgttagaagaatatctatgggtctagagggtgaagattttgcgtattatcaaagaaaaataccaggtgcatttataattgtaggaacaggaaaatcttatgcgcaccatcacccggaatataaagttgatgagaaggcaattttaaatagctcgaaatattttgcacaactggcagaaggtgctttaaaagagataatagataagaaatataaacataagattaagtagataaaggtacttaatttaaatatttattttgtaatatagtaaagaattaaaagttttaaagctacattactagtgattaagtttaataaagaaattgaatttcaattttaaaaataagtccctaacaaatgattgcaatgattgaaagaaattacaaagtgtgataagttggttgtaattagtaaaatttgaggaaatagttgcataaatgctccaaatagtttattagagattattatgatgaatcatttctgagaattattacggcagattggaattcaaaggagggaaaatgaggagatggagtacaagctatttaaatcattagcagataatcttccacagcctatatggataaaagaccttgaattgagatttatatatgtaaataaagaatacaaagctatatataaagatataaataaagaatttattggaaaaaatgatgcagagatatttgatggtgttgtaagagaggaatgtattaaatattgcaatcaagttataaactccttaaagccattaactgaagaagggtaccttgatggaaagcgcagaaaaattactatagttccgctaattgatgagggaaaagtatttgctgtagctggcatatatgcaaatttagatattataaaagaaaaagataagattatagagaaacaagaaaacatattaaaagttgtaatggatacacttccaggaagagtattttttaaagataaagaaggcagatatgtatatgtaaataagcaatttgatgaattctataataaggatggtataggagaagtagttggaaagacaaatattgatatacatccaacggaagaattggctgcaaaatattcaagagaagataatgaagtaataaaaaataaaagaagtataaaagctgaaacaatactttactcagaagatggagaggaaatatatacagaagcagtaaaagtacctgtaatcgataagaatggtgatgtttcaggtgttgtaggattagtattagatataactgagaaaaaagaagcagagaaaaaattaaggcaattaagttttactgatattttaacaggtttatacaatagaacatattttgaagaaaaagtgaaagagttccaaggtgaagagtatcttccggtaggagtaataatgggggatgccaatggactaaaattagtaaatgatacgctaggtcatgatcaaggcgatgaacttttaagattaatagcccaagcacttaaagatgtatgtggtgaaaaacagttgattttcagaactggtggagatgaattcgtaattttaagtaaaaatacaactgaacaggaatgtgaaatcattattaaaaatatatttgatcgttgcaaaatgtataagcacgatttaatcaatgtgagcatatctttaggtgcatcagtagcggatagcttgaataagagtatatatcaagcattaaaagaagcagatgataaggtatataggcaaaagttgctacaaaaaaccagtcttaatagttctataatgtattctctgcaaatgggtttagaagctaagagtttggaaactgaagaacatacagatagagtattagaaaattctattgcgataggagaaaagttatcgcttccaatgtcggtaatggatgagctaacaatagttgctaagcttcatgatatagggaaaataggaataaatgaagaaatattacttaagaagggtgagctaacagaagatgagttcgaggtagttaaaactcatacagaaaaaggatatagaatagtaaaagcatcaaatcaattagataatgtagcaaaaggtgtcttagctcaccatgaaagatgggatggaaatggctatccgcttaaattagagggcgagaaaataccgctagtatctagaattgttagtgttgcggattcatatgatgctatgactaacaatggtatttataagagatgcttgaataaagaagaagcaatcgaagaattaaaaagatgttcagggaagcaatttgatccaattatagttaaggcatttatagaatacttagaagaaactgaggaataataaaatctattgggaatttataataagagagaagatattcatgatgtgagatataattaacttaatgaaagctgcaatttttgattacaatccctacgttaagggatttttttatgtattcattaagtaataaagatataagtatgatatcatatgaagtaattacattatattggaggtgtgatatgaaatttgatatttataaaatagctgataattacaagctctcagaaacagagagacaggttttgcaatacatattgactaatattgattctgttttaactaaaggtgtaagagatgttgcaacaattaattatacatcggcggcaacaataataaagctatcaaagaagctaggttatacaggctatgtcgatatgatatatcgactaaacttcatagtaaaaaatcatcaaaacaatcaagaacatacctctgatattactagcttcatatcagaaattgaaaataagaaaatagaagatttcatttctatgataattaaacatagagaagatataattttcataacagccactggattctctgattcgattgcagatttcttttggagaaagatgttagtgcttgggtttaaatgcattaaaacaaattcttatggagtatatgacagcaatcaaataggaggcgccttagttattggaatatctaaaagtggagaaacggaaagtataacaaaagtgattgattatgcatcaaaaaatgaattggatattataacttttactggtaagtcagagaatcacatggctaaaaaggcaaccttaaattttatgatattagatgataaagaattagatgatagaaatcttaccgcgaactatttttatgctagggtaatgattgtaatggaatatttgctagataaggtaatgagtaatttataaaatatagatatccaaactaatcatacccatgtggaaacttactgaaattatatatagaaagctatctcgatgttaactaatgagatagcttttttaaagtgtaaaggtaaacatgtttacttttgagtcaacatgttgctgaaacgtttaaaactattaacaatatctattaataatgatatcctattctcacaggtaattacccaaagaaaattataaaatagtgaaggggaatatttaaatgaaagataagattttaaatagtatgcagaaatttgccaaagctatgattggaccggtcttattcttacccattgtaggtatgttgattgcattaacagcagttttcaccaatacaacatttgtaaaagaaggcggagcaatttgggtaacaggaaaattctttaatggaatgttatcaccgattatggggaacttaagcattttgttttgtgtcggaatagcgatggggatgtcaaagaagaaaaaagcggaagcagcattcatttccattatgtcatatattttgttcctaggcgcgaatagtaagtggttagagctatctggaaaaataattaaaggcgatacagcatcagctttatatggaacagggcagacaatccaattaggattccatgtgacagatatgggagtgtttctaggaatgattctaggagtactagttgctatagttcacaacaaatatatagataaagaatttagtggcgctatggctccatatggtaatagtaagtttgtattcgttatcatgattcctgtagtagctatattaagtattggtactacatatgtatggcctacaatagctgctggaatcacagctcttactggatttatgagttctgcaggggcagctggagtatttgtttatggatttttaaatagattcttagttccaacaggcttacatcatttaatttggtctccattcctatattcagcagttggtgatcagatgataataaatggtcaaaatgtaattggagcaaaaccagttttcttagcattgcttaatgattcaacaatttctatcatgcctgattcagcaagatttttaacatatggattagttaaaacctttggtgtaattggagttgccttagcattttacttcactgctaaaaaagcaaagcgtagtaatttaaaggcacaattaataccatcaactttaacagcagtaatcgcaggtatcacagaaccattagaatttacatttatttttgctgcaccattactatggtttgtttattcagtgattgatggattattccaaatgtttgtatacctattaaatgtaagagtatgtgcaactaatggaatattagattttttagtaataaacttgccagcaggtataggcaaaactcattggcctgtatatatactagtaggattagttgaaatagttgtgattttcttagtattcaaatttatgattgagaagatgaatttaagaacacctggaagagaagagaatgatacagatgctgtaattgatttaaatgagaatgcagcaaaagttaagcaagatatgaaatcagaaaataaaaataatagtaaagctaataacgatgatgaaaaagcattaacaataattagagcattaggtggaaaagcaaatatagtaacagtagaaaattgtttttcaagacttagagtggatgttatagataacaccttaattgatgaagaagctttaaaaggaacaggcgcagcaggtgttgtgaaaaagggaaataatatacaagttgtatatggcctttcaattaataaaattagaacaatagtagatgaagcattagacagagcagaataaaatgaaggaggaattattaaaatgaaaaaatttaaattagtaatagtaggcgggggaagcacatatacaccagggatcgtaaagagtttactttcaaagaaagaggaatttaagatatcggaattaagattatatgatataaatgcagaacgtcaaaataaagtaggagtgatagtaaagaaagtagtagaaatgtttgatccagaggtgaagcttgttcttacaactgatccagaagaaggatttaaagatgcagattttgtttttgctcaaatgcgtgttggattatataagatgagagaacaagacgaaaaaattccactaaaatatgatgtggttggtcaagaaacatgtggtcctggaggattagcatatggattaagaacaatatatcctatggttgaaatgatagatttttgtgaaaaatatgcaaataaaaattattggattgttaattattctaatccagcagccattgtagcaaaagctatgtataagttaagaccaaatgcaaggattttaaatatatgtgatatgccagttgcaattatgagaaatatggctaatatcttagattgtgatagacatgatatagaagcagattattttggattaaatcactttggatggtttacaaaaattagagttagtggtgaagataaaactgaggagttaaaagcatatgtaaaggaacatggttatattccaccggattcaaggagtgaagtaagacataatgatgcatcatggcttcatacattcgataatgctaaacatataatgcaaatgttccctaaatatcttccaaatacgtatatgcaatattatcttttaggagatagtattgtaaaagaagcagataaaaatcatactagagctaatgaagtaatggaaggaagagagaagaagatatttgatgctgtagatcaatataatgctacagggcaaattgatcttacacaattctttactggagtgcatggagaatttattgttgaagttgctatgagcttagcttttgatttaagaaagagacacttagttatggtagaaaataatggggcaataaaaaacttacctgacgatgccatggtagaagtacctgcatatataactaaagatggaccagaaccagtacgtgtaggagaaataccaactttctataaaggaataattgaacaacaagaagcatcagaaaaacttgtagttgaggctgctattgaaggctcatatgaaaaagcacttatggcatttactatgaacaaaacaattccatctgcatttgtagcaaaacagattctagatgatatgattgaagctaataaagaatattggccagaattgaagtaggatagagaatgtttaaaaatatattaaaaagaaataaaaataaattattatatgcttttacagatggagttagcgtagatataagtgaagttaaagatgaagtgttttctcagaaaatgatgggcgaaggtattgctattaaaccaagtagtaataaaatattttcaccatgtgatgggactattgttacaataatgaaggaaagcaagcatgcaataggaataagaacagaggatggagtagaaattctaattcacgtgggacttgacactgtaaatttgaaaggtgaaggctttaatttgtattgtgaagaagaaaaatacgtaaaaaaaggcgagttacttttagaattcgataaagaactcctaaaagaaaagggaatagaagatataacaatgcttattattccaaatttaaatggccatgaaattctaaattttcatatcggagaaattatgaaagttaaagaaagccctataattgaatataaatagatatttatagaaataagcttcattgttatatggagcttatttttttagcaaattctacgttaaagccagcattttatcttatcacggcattaggggaacgtggagttaagtgcctagaataaaaaaatgagtattcaaggtgagtataagaatagatagaagagcaagataatcgtaagaatatattagaaatgatattgacaaaataatttattaatatataatgaaattaataagacccccctacacagggggaggggaggaagaaatgagtgaggaaagaaaaaaagcattacaatctttaaaaacagcgaagggtcaaatagaaggaataataaaaatgattgaagatgatagatattgcatagatgttgcaaatcaattgatggcagttcaatctttaataaaaaaagcagatttaatgattttgcaaggccatttacgtcattgtgtaaaagaggcttgctataacaacaatccagatgagaaaatagaagaatttaataaagttttagaaaagttactttcaaaatagaaccgattattaagagatgacaatatgaaataaaatataaaagcattattgcattaattaaatatagagaaaagttgtaaattgcttagtgaagttaaaattagcttaatgtaaatttttaaagtatatgctaaataagtaaagaggtgaagtatgaataaaaaagcatttaaaattgaaggaatgacatgctcagcatgtgcaaatagagttgaaagatttgttaaaaagttagaaggcgtaaatagcgcaaatgttaactttgcaacagaaacgctgaacgtagagtttgatgaaaacaaacttaataatgaaaatatagaagcaaccgtagttaaagccggttacggtgttaagaagaatatgaagacttatacttttaaagttgaaggaatgacatgttcagcgtgtgcaagtagagtcgagagagttactaaaaagcttaagggggttcaagattctgttgttaatttagcaacagagaagttgactataaatatagatgaagatgaaattggatatagtgaaattaaagctgctgtagataaagcagggtataagctaattaaggaagaagagcaagttgaagaaaagaaaaaactagaggcaagtcaattgttattaaggagatttattatatctctaatatttgcaattccgcttttagtaataactatgggacatatgttaggtatgcctcttccatatattattgattctatgatgaatccattgaattttgctgtgattcaattagtattaacaatacctgtaatgatagctggatataagttctatttagttggaataaagaatttatttaaactaagtcctaatatggattcgttgatagctataagtactttagcggcagttttatatggaatatttggaatttataaaatacaaacaggcgaaactgaatatgctatgcacttgtattttgagtcagcagcagtcattttgactttaataacacttggaaaatatctggaggcagtttcaaaaggaagaacatcacaagcaattaaagcgctaatggggttagcacctaaaactgcaacaataataagaaataatgctgaaattacaatacctatagaagaagtaattgttggtgatatagtcttagttaaaccaggtgaaaaggtacctgtagatggagaaattattgatggtagtacatctattgatgagtcaatgcttacaggggaaagtattcctgtagaaaagatagtaggaagcagcgtaattggagcaagtatcaataaaactggctttataaagtataaagcaactaaggttggaaaagatactgcacttgcacaaatagttaggttagttgaagaagcacaaggatctaaagctccaatagctaaacttgcagatgttatatcagcatattttgtgccaatagttataatgctagcaataatagcctcaataggatggttaatttcaggagaaacaacaatattctctctaacaatatttattgcagtactagttatagcttgtccgtgtgcattaggccttgcaactccaactgcaataatggttggaacaggtaaaggtgcagagaatggtgtgttaattaaaggtggagaagcattagaaactactcatagtataaaaactatagtatttgataaaactgggactataacagaaggaaaaccagtggttacagatataataacaaatggaatttcggaggatgagatattaattttagctgcaagtagtgaaaaaggttcagagcatccgttaggagaagcaattgttaaagaagcaaatgacaagaacttggaacttaaagaaattcaacaattcaatgcaattccaggacatggaatagaagttaagatagaagaaaaaaatattttacttggaaataaaaaattaatgatagaaaaaaatattgatattgctatgtttgcagatgaaagtgatagattagcagctgaaggtaagactcctatgtatgtagcagttgataatactttaagtggaatagtagctgttgcagatactgttaagccaagtagcaaaaaagctatagaagctcttcataacatgggaataaaggtagctatgattactggagataacaaaaaaactgcagatgcaatagcaaaacaagttggaattgatatagtgctagctgaagtattgcctgaagacaaggctaatgaagtcaaaaagcttcaaggagagaacatgaaggtagctatggttggggatggaataaatgatgcaccagcattagctcaatctaatgttggaattgcaataggatcaggtactgatgtcgcaatagaatcagcagatatagttcttatgaaaagcgatttgatggatgttataacagcaataaaactaagtaaagcaaccattaaaaatataaaacaaaatttattctgggcatttggatataacgtactaggtataccagttgctatggggatacttcatgtatttggaggtccattattaaatcctatgatagcagctgcagcaatgagcttaagttctgtttcagtacttacaaatgcattaagacttaaaaattttaaagcctaatcaataagatatgatgataagcaaaaatagaatattaggacatttcttaggtagtagataattacatctagatgcttgaagaaaagtatttcaaatatctatattttgatttctaaattttaatcattaataaacgggaggtaatagatatgaaaaagaaaatattaattgaaggaatgagttgtgaacattgtgttgctcatgtaaaggaagcactagaaaatttggataaggtaacttcagttgaagttagtcttaaggacaattgtgcaacagttgaaactgaaaatagtaatgaagaaataaaagaagctattgaagaagaaggctatgatgtagttaaaatagaagaataagacaaataatattctttcaaaaaatctggttaaacgtaaaatttctaaatttaatgaatttaaagaatagattaaacaatttttatagatagttaacaacaaggatttattttccgtgttgttaactatttatttttattaatttgagctatctgtttaacagttatagaaaaaaataatatgcatataaaatactattacttattaatacgtattaaaacatcattataatgtattgacatttttatcttatagcaatattattcaattagtagaaaaatactaaaaaataatacttcgataaaatttaaagggggacaatatatgaaaaaatttttattaaaaaagttaatagtatttgtggcaattagcagtatagcgtttggaattataggatgtagtagtaacactaatagttctggcaaaaattcagatgttaagtcatcatcattaagtgatataaaatcaaaaggcaaaattgtagttggaacgagtgctgattacccaccatatgaatttcataaagaaatagatggtaaggatcaaattgtaggtattgacgtaagtattgcaaaagaagttgctaaagatttaggtgtagaacttgaaattaaggatatggattttgatggacttcttgtatcgcttcaggcaggaaagtccgatttagtatttgctgcaatgaatccaactgatgaaagaagagaaaatgctgatttttcagatatatacaataaagagaaaaatatatttatagtaagaaaaggtgaagcagattcaataaaatcaatggatgatttgaaaaataagaaaattggggttcaaaagggatcagttcaagaaggcttagtaaaagataacttaccaagtgcggaagtgaagggattaggaaaagctactgacttagtacttgatttaaagaataaaaaagttgatgcaatattacttgattcaccagtggctaaatttaattgtgataaaaacaatgatatagaattgacgtctgtaactattgaggcgcaagaagatggagcagcgatagcaatgaggaaaggttcgactgaattgcaaacagaaatcaacaaaacaataaaaagattaaaggatgaaggaaaaattgatgaatttgttgtagaggcaaataaattaatggattaggtccgaataaagtttgatcatttacataattattgatgtaaggtatcagtaacttccttacatcaataattttatattttaaagggagatgtttttgtaataggtcaatcaggttcgagaaaaagtatctatataatatactcaaataattggcgaataatatttctagcaaattacactgtttaatcagaaaagatatacttactatttaagtttaaaataagttgcataacattatacaatacgttataatacgtatcaacaggttcgattaagaaaaatatttattccaagattagtagtaacgttattatgatacagttacgcaaggtaaaaagagataaatcgcttattagttgcagtaagtaatgtacttattaaaaaagtaaaaatgctatatgcttatacattactatttgggttaatgatcgtaagcatttgccaatgtaaaaaatataaattcgtagaatgagattataaatatataggaggaataacaatgaatattagagaaatcgtagggaaaattagatcaagtaaggaagacggaataaaggaagtgttcttagtagcatgtggtgggtctttagtagatatgtattcatcacaatattttttacaaagtgaagcaagagaattaagagttttatcatatacaagtaatgaatttgtacatgcgacaccaaaatcattaggaaaaaattcggtagtaatagcatgctcacatggtggaaatactcctgaaacagtcgaagcagctaaagtagctagagagaaaggggcagcgactataacattaacacataataaagatgcagatttaattaagtatgcagattacaatatcctttacgaatggggaaatgatacaagcgtagaagacaatccaatggcaataattctaaatatagcagtcgaaatattaaatcaaacagaagtttatgaaggatataataaatttatggaaggtttaaagattgtaaatgatgttgtaaaaagaggccaaggtttagttgcagaaagagcaaagaaatatgcagaaaaatataaaaatgagccaataacatatgtattaggaagcggagcatcatatggtcatgcctatggattctcaatatgttcactaatggaaatgcaatggatgaacgcatcagcagtgcactcaggtgagtacttccatggaccatttgaagtaactgataaggaaacactatatttattattaatgaatgaaggtagaactagagaattagatgaaagagcacttaaattcctaaataaatatggtgcaaaagttgaagttgttgattgcaaagaacttggaattagtgtaattgatagttcagtagttgaattctttaatcctatagtattctatagcatcttatgtgtgtatagggaagaattagcaaaacttagaaaccatgatttagataccagaagatatatggggaaagttgaatattaaaatatttaagtgtaggagaagatattatggtaaaagttattgggttaggagataacgttgtagataaatatgagcatattagaacaatgtatccaggtggaaatgcattgaattttgcagcttatgcaaaaaaaataggaataaattcagcatttttaggtgcatttggatcagatgctgaagcagatcatgttcaaaatacaattcatgaacttggcttagatatttcaaagtgcagacattttaatggagaaaatggatgcgcaagagtaactttagaagatggtgatagagtttttcttggaagcaatgaaggtggagttttaagagaaaatggattaaatcttacgcaagatgatttagaatacattaaaacttttgatttactacatgcaggtttatacggatatacggaaccagagcttgataaaataagagcattaagcattccaatatcttttgatttctctgatgattttacaattgaagaagtcgaaagaattgcgcctaaagtagattttagtttcttctcatgtagccatttaaagaccgatgaaatgcttaatttagtgatgaaagctcataagcttggaagtgaaatagtagtagttactatgggagaaaaaggtgcattattatatgatggaactaagttctattcacaagagccagagcttgttgaagctgtagatacaatgggagcaggagattcattcataacagcattcttgataaattacataagcaaaattaaagaaaatgaattgtatagggaaaatataattaaagaaagtctaaatgaaggtgctatattttcagctaaaacatgtctagtagaaggctcatttggatatggtaaaaaatattaattaaaagtatagtggctgttgaatagttattatttaatgagcaatatcaaacagctattttaagattactgtaataaatcaaagaattgatattatcacaacaatagattaattgaagtttcaaaaatgttgtgatagtatatagttaatattatagatgtttaaaaggagtctttatatgctaatacaagataatattattcctttatatcaacaattagcggatattatacgtaattcaataacgagcggagaattaaaatatggagataagattccaacagaagttgagttaagtgaaaaatataatgttagtaggataacagtacgtgcagctataaatgaattagttgagtcaggttttattataaaaaaacaaggaaaaggaacatttgtaagtaagccaaaagttcagaggaaaattgaatatttatctagttttactgctgcctgtgaggccagtggcttaaaagtaactaatgaaatcattaaaagagaggtaatggagcccaaaatagaagacaagaaagatctagaactagatgatgatgataagttaatatatattcaaagagttagatttgcaggtggagatccattaatgctagaaaataattatttttcttttaaaaggtttaattttttactaacagaagatttaagtggttcactatatgaattattaagagataaatatgatataaatccatctgattcgcctaactcaggaaatgatcataccacaatagaaattgcaaaagctatggatgaagaggctgcgctattgatggtgcaaaagggtgaacctttgttttatataaagactgttatttatgatgataagaatagaccggtacatataggaaaacagtacgttataggcgaaagatataaattcgtaatatcatagtatataaattcttaaatgtaaaatattgagaagtactagatacctaaagttatatataaaaaccgaaagaaaggtcatgcatttgttccaggttgctggagtatttagctgtgaatttccaataggaaaaattgcaccattcctgcatgctcccgaggcaagctcgtgacaagcaaaaatggaacaacttctactaaggaaatatctacagctaaatgctcaatgcaacacttccacaaaagtatgacctttctttctggtatatactacaattaaaattatatgtttgggtttgggttagatatctaggcgcgaaataattagaaatcaatatggtggattgtgctcttagaaaacttaagcaaaatcttcaaaggaccgaaacaaacgcatattccctttcgaaggtttagcagtaaacttaaaatttcctcatattgtaagtgcttttatatttcacctagttcgcaacacttataatttgagatactttattaaatgcatagtccattgcactttctaaatttgaattattttttcctgctccttgagcttggaaaggacttccgccgccttttccatcaataagagatatagcatcttttaaaagttcattcattttgatatctttaatgtctttagaacaagcaaataatagatttactttttcatcagattttactgccattagagctattgtgttctcattttcgataagcttagaagtaaggttattcacatactttaggttttcaccatcaaatatttgtttaattactttaacattatttattttagctgcattttcaagaatttccttaacttgatatttagctagtagaatgttaagatttttatttgtttcattagcttcacgaagattttgatttaagttctttataccatttatagcttcattttcattacaacttaaatatctgcatatagaagtttgaaattcatctttcttaaatgaatcagaaatagcacgttcgccagctagaaactctattcttgttccctctttatgtttctcaaatttttttattttaataagtcttaagtcaagagtagatgtagggtggagtccgcagcaagcattaatatcaaaatctcctatttttacgattctaatatcctcttcagtatttggaagagcacgtctaagagataactttttaagttcggctttagttggaacaaaagattctacaggtaaggcatcccctataactttattagcaagtctttctgcttctctaacttgttcttcagttaagacaccataaatatctactgtgcttatatcagaacctaggtgaatagcaaaagtattagcgttaaaaaggttgaagaaagatcctgataaaacatgttgacctaaatgctgatgcataccatcttgtcttatatcccaatcaattgaacatttaaccttatgtatcttgagtggtttcttttcaaccacatgataaacaatttcctctttttcgtatacatcaataactttttgatcttctagagttccaatatcacagctttgtccgccacctcctgggaaaaatgctgttttatccaatataacatgaaatttattatcaatttcttttatatcaacaatttcagcagtaaattctttaaggtatcgattatcataatataatttttccatatgtaaattagcctcctaaaatataataatatctaaggctcagctataaataatttttatagtttgtttaacctgagtctaagaaaagttcaataatatcattatagcagatagttcattaatattgcatttttaagaatcaagaaataggtacaaaatttccttaaaaattattattaccctatagtagaagttttttacgggataaaagagttaagccctacaaataatattagtactttaggtgtacaaaaagatatgtatcttttatgcattgatatttagaagaggtgattaatatgaatgtagtgttttatctggtatttaattttatattttattcatttatagggtggatattagaggaaggttatagcttttcaactacaaaaaagtttcaagaagatggtttcttaataggaccatttaagccgatgtacggaatggcagttatgtttctcataatatgcaatgaactgttagagatttctggaattccattaatattattatgtttcttaataccaacgacagtagaatatataagtgggtatatacttaagcactcttttaacaaagtatactgggattattctgaatttaggtataatattcatggatttgtcactcttagattctctatatattggatggtgcttagccttattggtctttattatttgcaacccagtctatatgacttatacatggagaatatgaaaattattaatatctttgtagttttaggaggctctatattattaatagacctatatataactgtaaagaaattagaatatgagaagcttagaatgatacagtaattttattgaaaaaataatagaaatcatatttttataaaaaatagatataaatattatttgagtaatatttatatctacctaaattatataatttattattttaaattatatagagaagctaacttatcaaaagcaggcaaagatttttctattttctcatatgaagtgcagtaagctaatcttacgtgtccagggcatccaaacgaagagcctggaacaagtaataaattaaattgttttgcatcttcgcagaactttttatcatcatcgattggtgattttggaaataagtaaaatgcaccttgtggtttaacacaagtgaaaccaagagatatcaaatgattatataaaagatcacgatttttcttataaatatttacatccacttcagcatctaaggattttgcaattaccctctggaataaagatggagcatttacaaatcctaaaattctagttgcaatatttagtgaagccatcatatctgtaaaatcagccatagatgagttggcaactacataaccaatacgttcaccaggcaaagataaagatttactataagagtacccaatgaaagtattatcataatattttaaaatacaagggacttcaatatcatcataaacaatttctctgtatggttcatcagagatcaaatatattgatgtattaaattcttcttgcttattattaagtaacgttgctaagtcttttattattttctctgaataaataacaccggtaggattatttgggttgtttattattaaagcttttgttctaggagtaataacctcacttaaagcctttaagtcaggctcaaaagtttcagtattagtaggacaagttactagtttaccatcaaaattttttacatagttcccatattctccaaagtaaggagaaaaagtaataacttcgtcatctggatttaatatagattttaggattatatttaatccgcctgcagccccacaagtcataacaatattatctttagaaagttgtaagttatgtttttggtttataaaatcacttatatttgttctaacatcatcatagccagaattgttcatataaccatgtactaaatttggtgtttcttcattcaaaatttcaaagataacttcctttactttacttggaggttcaacatttggattccctatactataatcgaaaacattttcttctccatatatttctgataatctttttccttcttcaaacatagctcttataatggaattatttgcaacaagagatttcattttatttgatatcatttctagcccccgatttatatttaaattttattctaatttttgaaagtgcattcaatttgattgatatatatagtttatcacattttgtaataataattaataacacagtgatttatttaggaatatattacaattaaatttacataattttagttttaatttggaactcaacttgtaagatttatgtatatattgcaaaaataaaccttcatcataattctaaaaatattaaaaaggttttacccaaaattgtgaattgtgaaatgtgcattgtgaattacaatatatatatgttctaataaagttgctacattttaacgcatagcctgtctattgtttgtgtaggaactttatttattgttccaatgaagttttgtatagcaactcgaatactagtccaacttttaaagaatacattgtttaccactgatgattttaaccatccccataacccctcaattagatttaggtcaggactgtatggaggtaaaaacattaattcaagtctatttttcagtttttccaaaaatggttgtatcaatttagcatgatgaattttagcattatcaagaataataactatcttacccttcgggtattgcgtaagcaccttctttaaaaactcaagaaaaactacagcatcatatttttcgtgttcttcacaatatacatgaccactttcataatctagtatccctattaattttacgcctgcattctttccataagtaggtatctttcgttgtttcccttttataaaccaagtcttttgaatggcctgataatctcttatcattgattcgtcttgaaacaagatagtatcaactaagccatcaaggtgttttttttagatattcaaaatcattcttgaaagtttcttgtttttctttatcagccttttttaaaacatatgttggtcttgtataactcaaatttaatctgtgaagtataactgccatactactatgttttatagtaatactaaaattaaccatgacccattgacatattagtttgatagtccagttttttattgattcaaaacccacttcgtcaggcgtattatttgttattacataaataagtttttgttcttgctcagaatttaattttctaggggcaccaggcggctttttcatagcaagaccttctaatccattggccttatattttttaatatagttaccaacagcatgctcttctaatccttccatttctgcaattatcttattttgaaaaccttggaagtgttttaaaactacagagtaccgcttatacattcgtacacttttagtttctgtcattgctgtttcaagttctaatactgcactctgattatcttctattgtaattctgtttaaattcatcattgggatcaccaaaataaatctagatttattttgtgcaaacttatcaaataatataaacatgagttaacaagcaatgaattttattaattagaacttatatatataaatttatttctaaaatataatatgtatcttagtgagcgcttagaaattatattatatgttccaatattgatttaagtttagtgaagcttaaaataacgtgaaactttaattaatgtggttgaaaataaaaaaatcgcatgatatgctaatatgtgtacaaaaaagtagaaattttacattaggtattgagatatggtagaacggtttcagtggataatagttattatagattaatataacagtatattaattaaccagtagtattgaccatgtatagagaatcttttgggtattaggtaattcatagtagttaaaaatcaaagtatatatgattttaataaaattaagtataagtattaattagatgataaagtagaaagaaggggtgttttatatgaacgaagacaaaaaaattagtttattacagtctgttggagtaaaaattttctctggatatttcataatggcattagttggaattgggataggaatagggataaaaactagtacgacacttacggctatagctgtaggaattgccgttatattagggggcgtatttgtagttacaacattaggtaaaataattacaccactacatgaaataaagaagttagcagaaagaatgagcgaatatgatatttcaactaatattacaattacaagaaaagatgaatttggatttataggacaagctttaaataaagctcaggataatttaaggcatatgatagaagtgtgtgcagataacgcaacaaatgtgtccgctttaagtgaagaagcatctgcggttgttcaagaaatatcaactagtttggaaaatataaatttagagtttgaaaaaatcgattcaaaaacacaagataatagtagcaatgttgaagaagtatatgcatcaattcaacaagtaaatgccaatatggaagaattagaagcacaagcggaaaaaggtaatgataattcaaatggtataaaggaaagagctaaggctgtagaaaaaaatagcagaagagcaattgaaagtacagcacttgtatataaccaaaaggaagaacatataaagaaagcaatagaagaatcaaaggtagtagaagagataaaagtaatggcggactcaatagctagtatagcagagcaaactaatttgttagcattgaatgcagcaatcgaggctgctagagcgggtgaatcaggtaaggggtttgcagttgttgcggaggaagtgagaaagcttgcagaggagtcagcatcatctgtaattactatacaaaatactatagaaagagtagaaaaagcatttaataatctttcagagaatagtaaagaaataattggtttcattaaaactaatgtaaaagaagatttagaaggatacggaagtatcgctttacaatatactaaagatggtgagtttgtaagtgcaatgtctaaaaaaatagctgagatgtctgaacatgtaaatgtatcaattgaacaggttagtgcagctatatcaaatactgcaaaaaattctgaggaggtttccggtagtacacatagcatacaacagggaatagatgatacatcaactgctatgaaacaagtagttgaaacaataagtaaggaagctattaaggcagaagaactaagcagtattatttcaaagtttaaactataggatatataacataatgcacaatgaacaattagtataagattgtcattgtgcattaaaattttactttatattaagatttccactttcagtagtaatatttataagagaactttcatcgccggaagataatttatcgttaggagaatttaagcttccagatttcgtttcgtagtttattttatagcctgagccttctggtatagataagtgtatggatccagaatgagagcttaaagacatattgttcaaggaatcaattattctcagattgatatctccagataaagtatttccatttatacttcctaagttaccatttccaataatatcaccagaagaagaagatagtttggtttcagttgatgtttctatattatcaaaggttatatttccgttggaactatttaagtctaaataatttaaaaatgaatctgaaagagctatagatccactagtagatgaaagattaagtgtatttaatgataagctagaaatatttatatcgccgctgcttgtggttatttttaaagtgctcttatctttaaaattataaggtatacttactgaaatacttgcgtcactgggagtatcatatctagcgttgaaagctaatctattaccactttgaatttcatacaagtcattagaaatattattgttgcttttgatttgaatttttaaatcatcaccatcataatcaacgactttaatatcttgcgagtttaagctgaagtcaatctcattgacattatcatttaggacataatctttagacagatatgaagtattaaaatccaagttgaaattgttaaaattcaaattatgttccaaggcactggggcttagatgaagttcatcggcgtagttagaaagtttgtagccactttgaactagagcaatgcatccagaagtataaaatgtaatggatagaagtaatagtattaacataaatatcttcatattagaagaaatgaatttctttttcatagcgactccccacctttaaactttaagaacttatatgttttagccaaaattaatatgagaaatttgcagagatagaaaaatataatcattaaaagcagtgataatgagagtgaacctaaagaaaatagtactattaccgggtatggaaaattcgagacaaatgctggaatattaggtagcgtaaaaaagtttgtaaaagttccaccaattagtactccaatactagcgataaaaatacttattgctattcccaagagtccgataaagcagccaataacaccagttataactggaaagaatattactaaagataagattacaataaaaaattttaagataatatttatgttgaagttagaaatcttatttttagatttattattaaaaatactcattatttgacgcatattaaaattaaattctgagatgaaggaaatatgattactgcgtttaaagttattctcattattgatattatattttgattcttttaattcagcacatttataattgcttttttgaatatcaagtgatatattttcattatgaaggtcataaaaacaatcatttgaagcataagaattattagacttaaaatcattaaagttggaatcagtttttaaatcattcttgttttctgaatagatattactgaactttttattagttttaaaattgtgacatgcattgatatgtttattatcagtgctaacatcagtggcatctatgttagaaatctcgtcgctagtttcagtgctagcattattagttaaattatctaaggtaatggtaatatgcaaatgttcatttctaagtttattaactattaaattaggatcacctaattcctttgctatatcgtcttctgttcttccaacagttaatctagttttaaagtaattttcataataagaaataatatcttgcagctttatttcaggaaagtcttttaaaccatccattaaaatgttaaaaaattcattttgggtcattgcaataaatctccttttacctaacttcagaatatatttcctgattaaaagtatatgataggaatgaaaagaccacaagatattactttatactttaatgttttattaaggtgttgtaacttagaaattaacaaagtattaagaaattcttaagtatgcccatagtattttattggtagtgctattattatccacataaatatgattaattataaaatcgaattttgtaattatacgcttcaacaagaagttttgtgaataaacttgtggacaaacttaaatgatataaaataaaactaaggcttagccttgtaaatacaaggcttgtttatactgttgataatagtataaaatctgtggataacttaattgtcaaatatgatattcaattagttctttatgaatgttttaaaattaattatggacttgatttcaataaatgtggagataattgattatagagagagaaatttgtagaaagtctttcatgacaatttttcgttgagaaatttaatgatatgtatttataaacaatatgcacatatttgtggataaaaactgtggatattgtggataaataaaatttaactttaagaaatacgagaaagtagtataatataaatagtaattaatggaatttaacatattgtatgaagataagtgatttattttaaaaatattataattataagtatatatgcgaaagataattttaatttagaaaatttttaatagaggtttaatttataggaaagtataactataaagacaataaaagaaaaatgtataactagagaaatttattataaaaatctaaccgatagttaatggggaggggataaaaattatgaccaataaagatgttaaatatgttcctcaaataaagggtacgcttaggaatcatgtaattgaggttccggcagttataagaaattgtggtggaattaaaatttttgggaagagaataaaatcattgctatttagtacagatgtagcattaataagaaatagcaatgctgatgcaattattgcggtatatccatttacgccacagcctgtaataacacaggcacttgttatggccgctgatgttccggttttttgtggcgtaggcggaggaataacacaaggaaaaagagttgtgaatttagctatggatgcagaattcaaaggtgctatgggagttgttgtaaatgcacctacgagtaatgaaattgttaataagattaggtcaacaatagatataccagtaatagtaacggtcatttctgaagatgaagatattgctaaaaggattgaagctggagctacaatacttaatgtttcaggtggaagaaataccgctaatatagtcagaaatatcagaaagagatttccagagtttccgataatagcaactggaggaccaactgaagagtcaattaaagagacaattcaagctggagcaaatgctataacttttacaccaccaacatcagcaagtattatgggagatcttatggatgagtataggaaagaataggaacttaataagcttgggttttataccattaatttaaagttaaaaaagtattgctttaagtttaatttatggtatcatatttgtaacagtttaataaaatgatattgtgcagataatgatttataatgtcattaatattaaaatattaatgaattctaataatataatatataacatgacctggggtagaggtgctgcaataaatagtaggtatgaggagttggcaaacgttgatttatactaaaaggtattacagccgaagaaaatagattattatgcgataatctttttctgggtattcatagaatatgtgaataactgtcacgaagagtgttgagctacaaggtacttttttcagttataaattaacagtttgaaaagaataataatgattttgttagtatagacgttcaaattcatttattaatcttttgcgaagaattgataattaatgaaaatattgtgcataaatttagcgtaaagatctaccactcgtcacagatatactctgtggcgtttgttttttattataattattagttaatacaacagcaataatccggagttaatgcaaaaaacggatattttttattgaaattggtgttgtgatttattttaatcaatgaagcaatagctaataaaatataatttgggggttaatcaaatgaagttgtttggaacaatgaaagtagaagacaatcaattaatgattggaggcatcagtgctaaaaatttagtgagagaatatgggagtccgttatatgtatttgatgaagatttaataagagaatactgtagggattatagaaaatatttcaagtgcgaagagaataataatagagtagcttttgcaggaaaagcatttttgacacttcaaatgtgtaaattattgaaggaagagaatatgtgtcttgatgttgtatctggggggaattatacactgcatataagtctgaatttccacttgaaaaagttatgttccatggaaataataagactctatctgagattgaacttggcgtaagactaggtgtaggtaattttgtagtagataattattacgaaatagacgcattaaatgatatagctaaagaatataataaggtacaaaatatttatttaagaataacaccaggtattgaagcgcatactcatgattatataaagactggacaaatagattcaaaatttggctttgctccagttggtactgtaatagaagatgctattaaaaaagctataagtttagagaatataaatcttgcaggaatacattgtcatataggttcgcaaatatttgacttagagccatatgaagatgctgttgaaataatgttagaacttgtgagaaatacaaaggaaaacctaggttacctaataaacgaagtagattttggcggaggttttggtatatattataccgagggagacgaaccaagaagtactgaagaatattgcagcacaataattaataaagttgatgaagtgtgtgcgagaacaggtcaagaaaggccaattcttacaatagagccaggaagaagtattgtagctaatgcaggaacaactttatatactgtaggatcagtcaaggaaattccgagtgttagaaaatatgtatcagtagacggtggaatgactgataatataagaccggctctttataatgcagaatatgaatgtattcttgcaagtggagttgaaggagatagagaagaaacagttacaatatcaggaaaatgttgtgaatcgggagatatattattagaaaatattaaaattccagaagttaaaagcggagatattctagcaataatgactacaggagcatatggttattctatgtcaagcaattataatagaataccaaagccagcggttgtaatggttaaagataatgaaacaagacttatttgcaagagagaatcttatgatgatctattaaagaatgatgttgaatagatataagtatttgaatatgtttaagtaagaatttaaattatatagatttcctaaaaggattatgcactaatttttaagattggtgcatatttttgttataaaattaacatcttataaatattttagatagtaaaatatgttatactaatatagcatattaaaatatgcacattagaaaaaagcgcgaagcgcaaccaagatcattttaaattagaaaaagcgcgaagcgcaaccaagatcattttaattagaaaaaagcgcaaagcaaaatcaagaactttttaagtgaaatgatttatataattaaggattatgaaaaaatggggtattaatgaaaaattatgtgtaatatgggacatggaggtaatattgtggcagaaaataacgaagatgaaattgtagcagataaaaaagaaaaaaagaagtccatattaaatgaatggataattgttattgcagttgttctttgcatagcgcttctcctatggaattttgtgggatacggtgtttggattacaagtggatctatgattccaacattagaagttaaagatagattgatagtaactagggtgcataatcctaaaaatttaaaagaaggagatattgtattatttaaaaatgacgaatttaagggtgagattttaataaaaagattaataggacttccgggagatacaatagaaattaaaaatggtgttgtttatagaaacggtcaggagctcaaggaagactatgtgaaaaataatgagatatacaatggaagttttaaagtaccagataataagtatttcttcttaggtgataatagagctaactcagatgattctaggtattggaaagatccttacgttgatgaatcatatatagaaggaaaggctcaagtaaagtattatcctataaaagattttgaaatattaaaataatatgagttaaattttttacaaagtgtgaataatacttagtatgtggtataagataaacgaatcttgcaaaagggagaacatttaatgaatgaaaatgattatataatggaatcaaaggacatagatttaaattgttctgataacatcactaataaatcagataacgattttctaaagaaaaaattagacaaaaaagagaataaagaattgctatctaataaaaatattataggaagtttttcatttgaaagcactttctttagagagtggataattcctataatagcagctataggaatggcttttttaataaataaatttctgatttatgccgtatatatacctagtgaatcaatggttcctactttaaatattggcgataaattaatagtaactagaatttatgacactagtaggattaatagaggagatatagcagtattctattcaaaggaacttgatgaggttcttataaaaagagttataggtcttccgggagatcacattgaaatacacagcggtactgttactgtaaatggatcagatattaaagaagattatgtaaaaaataatgaaaattttgatggggttttcgatgtgcctgaaaataagtttttctttttaggagataataggagccgatcaaatgatgcaagaagatggattaatccatatatagatgcctcaaatatagaaggaagagctgtattaaaattctatccatttaaagattttggaagcttaaattaatagtaagacttaagaatataatatggtgcaagatagactagcaagctcacttgttattttttagtgattactaagagttattggtgatattttcatagatatactgtataatttaggtgattagaggaaaacttacttgcgttcgctctctaagtaagctattcactattcttggaattaatttatactgtgaaaagaggatgctaagtgagtgaaaagtatataatagatagagtagaaggaaattatgttataattgaaaaggaaaatagggatatagataaaatatctattaggaatgttacaggggattttaaagaaggagatattttaattaatatagataataaatattttaaagtagataaaaagtccacagaaattcgcaaaaaacaaatagataataagatgaaagatatgtgggaagaatgagctgatttatgaatattaataaaatataaattcaaaatcaattcagatataattaagtttgatatttagcctaacttgtaacaaaggtgaaaaggtaaatgaaatgctatattgtctgaaattgtgttacttatataggaaattgatgaatataaaagtagtacagtattggacataatgattaataaatataatgggaaggtgattagatgcagaataataataatggtaataaaaagaataacaaaaataagaattcttttactatagcaattacttattttttaatagcttttgcatttttgatggcgtttaattatgcaagagaagaagctacaacaaaagagattacttataacgaatttttaagattgcttgataataaagagatctctaaagttactataactacagaaaacttattaataacgccaagtgaagataatgaagagtacaaaggaaaaactttgtatacagcaaatgtaaaggatgaaacattaataactaagcttaatgcagctggtattgattttacaggtaaaaatcctaaagaatcaccaatgatgaatattctccttacttggatattgcctatggttcttatattcttcatgtggagatttttattctctaagatgggcggaggcggaggcggtgtcatgggcatcggtaaaaataacgctaaggtctacatggaaagtgaaataaaagtaacttttgatgatgtggcaggtcaggaagaagctaaagaatccttaaaagaagtaatagacttcttaaatgcgccagccaaatatactgaaattggagctaaattacctaaaggtgttttacttgtaggacctccggggacaggaaaaactcttattgcaaaagcagttgcaggagaagcaagagttccatttttctcgctttcaggttcaagttttgttgaaatgttcgttggagttggagcatcaagagtaagagaattattcaaagatgcagtagctaaagctccatgtattattttcatagatgaaattgatgcaattggtaagagcagagataatcaaatgcaaagtaacgatgaaagagaacaaactttaaatcaattactttctgaaatggatggatttgattcatctaaaggtgtagttttacttggagctacaaatagaccagaaatacttgataaggctcttttaagaccaggtagatttgatagaagagttatagttgatagaccagactttaaaggaagagaagctatacttcatgttcatgcaaagaatgtaatgctaggacctgatgtggatttagctgaaatagctaagagtactccaggtgctgtaggagccgatcttgcgaatatcattaatgaaggtgctttaagagctgtaagaagaagaagaaaaacagttcttcaagaggacttaagagaagccgttgaggttataattgcaggtaaagaaaagaaagatagaattctatcacctaaggaaagagaagttgttgcattccatgaagttgggcatgcacttgttgcagcgatgcttaaaggagcagaccctgtacataaaataacaatagtacctagaactatgggagcattaggttatactatgcaattaccagaagaagaaaaatatttgacatctagggaagaattaataaatcaaattactgtaatgcttggtggtagatctgctgaagaggaagtatttgatttggtttctacaggagcttcaaatgatatagaaagagctactcaacaggctagaagcatggtttctatttacggaatgagtgatagatttgatatgatggctttagaatcagtgcaaaatagatatctagatggtagagctgtcagaaactgtagcgaagagacttctactattttagatgaagaaacactaagaataataaagcatgctcatgcaaatgctagacagattcttagagataatagagatttattagataaaatttcggaagtacttttagagaaagaaacaatatttggagaagaattctttgatttagtctatgaaaaatatcctgaaatgaaggaagaaaaagaaaaggaaaaatcagagaacgaaaagagagtaaaagagttagcagaaagaagagctaaaaagcatgctttagatattgttatagatgataagcctgaaaagtcacaaagagattttcaagatttagggaaatcagaattaataacaagtaatcaaacatctgtaattatggaaagtgatgcgaaggcagaaggcgcagctgaaaatattaatgatgatagatctatatctaaagaagaggaatctgataaaaaggattctgaaactgataatatttaaataaataagttgacattaatgacaggtttcaagtgataagttaatgaagaaaagccatcggctcttcataagataatatttttagaaatagagaactataaaaatgtaaatatagtatttaatgcacagtggaggaatgaaacctaaaaagagtttttagccatacattgtgcattttatagtttaaatgtataattaacaatacaaaattcatggaattggtgtgaaaatattggcataagggtataataatatttcacaggaagaaataaaagattagttattggtagttaatcgccctatataatacttaaaggtgatgaattaactgcctattgatctaagggggtcacaatattgagcaaacaagtagattttataagagaagaggaaaagttaagtgaaattttagaaattctaaataaagaaattttaaagtatttagaaaaaagaaagaatgtcacaaactatatccttgaggctagaaaaaaatacgttgaggaatataaagatgatgaagaccagattatagattattttgatcatgaaaattatgtgaaggaagaagcctatagaacaattgacaaaaggcttatggaatttacaaagcttaaggaaataccttatttcggaaaggtttcatttaaagaaggagaagacattccagaagatatgtatgtgggtagatatggattgacgctagaaaatagttttgaaccattaattgttgattggagagcacctattgcatcacttttttataaaggaactcttggtaaatcaagttataatccaccttcaggagaaatagaagtagacatattatcaagaaagcaacttgtaattaagaaaggccagttaaagggagtatttgattcagctatagatgttaaagatgaaatactacaaatggttttaacggataattcatcagataaattaaaagatatagtaatgactattcaaaaggaacaagatgagattataagagaggatagaaataaaatagtcgttgtaaatggggttgctggttctggaaagacaactatcgcacttcatagaatatcatacttattatacaattttagaaaacaatttggagataaggtattaatctttggacctaatgatatttttatggattatatagctcaagtattgccttcgcttggagaaagtaatattaaacaaacaacctttgaaaattttgcgaagaaagaaattaatttaaaatatgaaaatataaagagcttcggtagctatattgaagatgctatgaatggaaaagaagatactttagaagaatatagatataagagttctaaggcatttgttgatttattaaattctaacttagaaattttaaataaggaatattttaagatacaaccaattagatttaagaaagaagagattgttacagctaaagagatagaggaactatttacaaattattataaagatatgcctttgtttagaagaagtgagaaaataaaaagaatattaatatctaaaataaaagataagagagatgaagaagtttataagataaatgctgagtttaaagaaaagattagcagcttatcagagaatgaacttgaaatagaaaaaaataatctagaatatttaaaaagaattaagataagagaaattgtaagagcggttatgaaatctcgtgatgaattagatacttggattaagtacgaaccagtaatagatatttataagaaaattgttaatttagatactgataaaaactatattaatgacttagagaatattaataatgaagacttaggtgagaataaagaaagactaagctatatggatttatctggcatactttatttaatgattaagctaaaaggtataaaagtaaaaaatgagataaagcatattgtaattgatgaagcacaggattatagtttcattcaatttgaaataattaaagaaataacaggttgtaagagctatacaattgttggtgattcaaatcagagattaataacaactagtgaagaacctgcaatgcttcaccttgatgatgtatttaacgatcttaatgtggaaattacaaagtatgagttaaataagagttataggtcaactcaagagataatggaatattcaaataaattcttggataaagacaagattgttccgttggttagaaaaggagaacctgttattgaagaagaagtttctaataatgaggaatttgttgatacaataatatcattaattgaagattatgaagaagagggatacgagaatattgcagtaatctttaaggacaaaaatgaattgaataaattctctcatgttattaaagaaaagatcaatgttcaaagtttagataatgatgatattatgtataagggtggaaaagtacttctaccagcttatttagcaaaaggattagaatttgatggagctataatagtagaaagtgaagagatcgaaccgttagttaaatatataatgtgtaccagggcgttgcacaggttgtctgcagttaagtatttaatatagttacattataaaaacttaactctcaggccttattatcttaaaagctatacggctatataaaataaagaattttatatagagtgagctatgctatctgaaatttatatatactaaactagataatcaattttaaataataagtaggcggcaccgataacatgatatttatgatggtgccgcttttattttttattatgtgaataatttttcataaagtatgcaaagtgaaaaattataatataaatttaatgagaataaaatttcatgattttttgtgaattttaaattatagaaatactaaataaaatttttttataattttaaaatgattaaaaaacgcttaaagcaagcttgcaagccttataatactaatatatataactatttccaatacataaaatatatatttaaatatataataagtaatgaggataaatttaattttaatgaataataattaaactttttatcatatttctattgagtaaatataaaaaagtgtgtataattatgctatcgttagtagagaaaagttttggaggtattaataatgaaagttggtatagtaaaaaaattagttgctattgcagcggcatcagctattgcaataggtatggtaggctgtggaaacagcactaaaggaaacaaagaaaacacaagcagtaatgcttctgcattacaggcaataaaatcaaaaggtaagcttgtaataggaacaagcgcagattatccaccatatgaattccataaagaagtagatggaaaagataagatagttggatttgatattgatattgcacaagaaattgcaaaagatttaggagtagaacttgaagtaaaagatatggcatttgatggattgttagtagcacttcaatcagataaaatagatatggtatttgcaggtatgactccaacagatgaaagaaaacaaaatgcagatttctcagacatatattatactgcaacacatagatttgtacttagatcaggtgatgaagctggaataactaaaatggaagatttaaaaaataagaaaatcggagtacaaaaaggttcaatacaagaaggtatagcaaaggataactttgatgcagcaaatattaaatcattagacaaagttactgatttaatattagatttaaagaataataaagttgatgcagttttagctgaacaaccagttgctcaaataaatgttgataagaacgaaggtatcgcaattgctgacaaattagaagttaaagatccagacggtggatctgctatagctatgaaaaaaggttcaactgatttaacagatcaagttaataagacaataaagagattaaaagatgaagataagataaagcaatttgtattagatgcaaataaactagtagattaatcctattcggcactaaaaggtacgatagaaaataacgagttagagatgtagtatatattttgttattgacaaggtgaatttagataatttgatttattccttcatgaaaattatttaaaatctcagaagttatattgggattatttaaaatcactttgtacccgttgtgggtataagtttgactgaaaccgggtgataaagagagcttcacctgagaagttttaccttgtactaagtaatgaaagtttttagcatatagaaactataaggtaatacataccagtatagtagaatgcaaaatatactgacatcatagcttgttatttttttgagtattagatatatgttgtaaattcacaatgcacgtttcacaattcacaattgtggctaaaattcttgtaatatttttagaattatgatgaaggattattttttaaatatatatatttaaaattatttttatattggaaattaacaacagttgaaaattatcagataatgtcttataattaaaaattagtgactattttattatatgtgtattattaagtgaagcttgattcagatgggaggagtccttagctggatattagttgaacttatttagggtcgtgttactgtatatattacttaagcaggtagcctaaatatatgattcagtgtgaatcggttactcatctgactttaggaagaggagtttcatatattgtgggagtattatagtggctagacatcagataaagaactaggagggaaaatattgaattttacatttttaggaaaatactctgaatattatttaaaaggtgcagaaatcactattgtattagcattttttgcagtgctatgtggtacaatcttaggtcttgcattaactcttttaaggcgttcaaaatttaaaccaataagctatatagcagcagcttatgtagaatttgtaagaggtactccacttctagttcaaatctatataatctatataggattacctaagcttataggaatagatatgcctgatatgactgttggatcaatagctttagcattaaactcagcagcgtatatatctgaaataataagagctggaatcgaagcagtggacaaaggtcaaatggaagcagctagaagtttaggaatgaatcaagggttagcaatggttcatgttataattccacaagcatttaagaatatattacctgctcttggaaatgaatttatttctgtaataaaagaatcatcaatggtttctgttataggtgttgcagaacttatgtacaatgcaagtattgtaagaggaaatacagctttaggattagaaccaataattgtagcagcagtagtttactttgttttaactttcactttgacaagatgtttaggttatgttgaaaggaggatgaaagcaagtgatatacgttaaagatttacataaaagctttggaaaaaataaggtgttaaaaggaatagatgagcatatcagcaaaggtgaagttgtagttgtaattggaccttctggatcaggaaaaagtacatttttaagatgtcttaacttattggaaactcctacatctggacaaatcacttttgaagataaggatataacatcaaaggcaactaatatagataagatgagagaaaaaatggggatggtattccaacaatttaatttatttcctcataaaacagtatgcgaaaatatatgtttagctcctattaaagtaaaaggaatctctaaagatgaagctaaaaatatagcagaaaacttattaaataaggttggtttgatagataaaataaatgcttacccatcatcattatcaggtggacaaaagcaaagaattgcaatagctagagctttagctatgcagccagatgttatgttgtttgatgaaccgacatctgctttagaccctgaaatggttggagaagttctaaatgttatgaaagatcttgcaaaggaaggtatgacaatggtagttgttacacacgaaatgggatttgcaagagaagttggagatagaatattgtttatggatgaaggaaaaatattagaatctggaactccagaagaagtatttaagaatcctaaaaacccacgtacaatagactttttatctaaagttttataattaactatataacaaggcgttcgccaaataactatttttattagttattatggtgaacgcctaaaattttaatataggattccgcaatgaaaatcaaatttatgtggataccagccgaaattgaatacatatttgttccatacgactatgaaaatttcgctggaaggttctaaatggtaggttgcacccatcactgcatgttcccactttcagtgtgacaagcaatgaatagaacaacctgccattaagaacctaggcagcttattttcaaatgcctatttcatattatgacccttgaggttacaaatatgtatccaatttctctgcttgagatatctcgaattttcaatgaggaaccctatatccaactaagatgcaaacttttggatatactcgaacttttagtttaacaagctaaaagtagtacgaaggagaagaaaatttatgtggtgtaatcctagttgaaagccacatgccaagtgaaattactataaacataatatggagagctaatacaattaatggtgcggctaaattaactccgccttttttacgtaatttatttatatattcagtattgctgagattttgtatattgataacattcattttgaagtctttaatcttacgttcgcaattgttaagataaataaaatttgcatataaagttaatataattcttatgagtagtagcaaagataagtgtattccctttggaaaaatcgctgaagatactaaggttaagagtatcaaagcagctcctggaatataaagttttctgtataataaccaatagtaaccgaagaaaaaacatggccagttccaagataaaaatttatgtttatcgttatatttgttgaggtgcttaatatagaaaccgctattattaccaataaagatagctagttcttctcgagaaatattgttgcttttattgtaaggaatagaatatatatttttaaatttgtttgtattctgattattataatagtcatttctattatgatagactttgttttgattaaagttatcattagatttggagttgttttcaacatgatctactttaatatcagcattaactctactatttaagttttcttcagtataatctatattagttttttcagtatttttaatcgtattaccgaaataagaacacataggatttatacacacatcatttattcctagttcttctgaacaatgtggacatttcaaaattatatcctccttttaatagcacttaatactaaaaggatatcacaaatttatccaattaacaatgagaaggacggcaaataggatagggtaaaaaggaataatgaattgaaaaaatttaggtggagtttcagctttatttatacttatagttttaaggataagaatatgtattaaatgggatgcagcgatatagaaaaagtacagccgctatttcaaactagaagtttcttggtttgaaataacggctgtatttttatgtgtagtgtttgtctatagtaatgacacagttataagaaggatgatatttctttactccttcagatattatatttataagttcagtatcagttatagaaagtttttttgatggttcaataacaacgtcaaaaattaagttcttgatatcaccttcaccgactactctaaaatcatgtattgactctatataatcatatttttcaattatggatagaatttcatcataagcttctttgacttcgccttcaataatgcagataggatcgatgtgaataactaagtaaatcttaagtgcttttgaaatttctctttcagctttatcaatcacttcgtgaatatctacaacgttaatatttccaggaatttcagcatgaatagatgccatacatttacccggaccataattgtgaactattaaatcatgtgagccgaggatgttatcataagacaaaaccattctttctatggattcaacaagttctggatctggcgcttctcctaaaagtggatttatagtatctttaactaaattgaaaccggcataaacaatgaataatgcaacaaacattcctatatatccgtctatagggaaagaagtgaattttgaagctaaaaatgaaatagccacacaagtagtggtaaatacatcccctagagcatctgtagaagcagcttttagagcagaggaattaatcttttcaccaataaatttattaaatttagaaagccaaatcttaaaaaatattgatattataagcagaataaatgaaactaactcgaaagcaactggtgatggattaactattctttcaaatgaagattttataaattgcagaccaactaacattaccatgaaggcaacaataagtgctgaaagatattctatccgcccatgaccaaagggatgttctctatcagctggtttatttgaaagtttaaaacctaaaatagtaattaaagaggaggctgcatcagaaaggttattaaaagcatcagccattatagctatactcgaaactattactccaacagaaagttttattataaataaaataatatttactacaatacctatgataccgccaagaacaccgtaagaatttctaactgtgtcatctttaacattagaattatccttaacaaatttattaactataagttcaaaaaacatgaaatacactccaatcataagaaattaccaataagcattacatctattatattaaatatttttagttaagcaagtatttttttaccagaagttaagcaatctaacactaataaatatatatttcatattttaaatatattctaagtttatagtagcactttactgtgttataatttatatagaaaatattcgagggggcaatttttatgaaggatattatatttactggtgcagcagttgcaattgttacaccttttacagaagatggaattaatttctctgaattaaaaaaactaattgattttaatatagagaatggtacagatgcaattgtaattgcaggaactacaggtgagtcttcaactatgactgatgaagaacacagggaagttattagatttacagtagaatatgtaaataaaagagtaccagttattgcgggcacagggtctaatgatacagtttatgctgttgaattatcaaaatacgctgaaagcgttggtgcagatgcacttttattagtaacaccatattacaataaaactactcaaactggtttaataaaacattacaattatattgcggatagagttaatatcccaataattctatataatgtaccatcaagaacaggagttaatatagcacctgaaacatatgcagaattagctaagcatccacgtatagttgcaacaaaagaagctagtggggatctttcagcgattgcaaagataaaagcgatatgcaaagatgaacttaatatatattctggaaatgatgatcaaatagttccgatattatcacttgggggaaaaggcgttatttcagtcttttcgaatattatgccaaaagagtcgcatgaaatttgtagtttatattttgaaggaaaagtagaagaaagctgtaaccttcaaacaaaatatttagatcttataaatacgttatttatagaagtaaacccaattccagtaaagactgcattaggaattatgggatataacgtaggaccacttagaatgccattattcccaatggaaggcaagaatctagaaaaattacgtgaagaacttgctaaaaataatcttatataagttttagtgtgtattttaagtatagataaataatatttaatttagatttataaaataattcatataaataagcaatatattaatgaacgcttggatattataaattcgggcgtttattttcgttctttacaaagaaattataaaaagttaaatttatagataattattggaaatgtcagaaatatatattttacgaggcagatgcgtaagaatttttttgtctaccattttactgcatcaaactattttatagataagccaattataagctggatttatactatgaaatatatcccaaatagaaatggggaatatacttttgtggaatgtttcattggtaattttgatggatttgattctttggctataagttgttccaaatgtgctagttcaaagcttgttctttgaggctagaactttgggtgcaactttatagccttagaatcacccatcagaattacctagaaactggaacaaaagtatattattcatttcggcgagttatatacataagttaaggtcttagttgggttatctatatgaattagatccaaattaaaatttagatgtattttacccatggaataaaattatttctaaaaaaatataaaaaattttagagaaattatgtaattgttcatttttatacatatattccatatagaagactaatttaaatgggagagtgttaaagatgaaagaaagaaaatttgttaaattaagagttgatatgtatgatgatactaaatctaaaataatagatacaatgaatgaaagagatcttattcagtatatttggattagacttattgttttagctggtaaggtaaatttagaaggagaattatttttgtctagaaatattccatacacaatggaaaccatcgctatagaatttaatagagatattgaacgagtgaaattagctatgaaggttttaatggatttagaaatgattgagtttactgaagataaaatctataaagtaaagaattttgctaagcatcaaaatattaaaataaataagagtactgaaattaaagataatgtagtaaaagaaaatgattctagtcacaaaatggatgagcctaaaattaaagatagagaaaatctaatgggtgttaattcaaaaagtagtggatataaaagtattgatgaaattgttagaaataaaactgctaaaatcgaagataagagtactatgattacaaaggaagagataaatgaaaacaataatgatgataataatattaacaattgtaatagatataataaagattctaccagcgtggattctgaatttgtggttaaaggtaatacagaaaatgaaagctttgcaaatagtaataaaaataatagtaatactataagtgctggaataactcagaataatgatactataaatgctagtatagatcctactaatgataaagataataatgaaaacatagaatgtgtagataatactagaaatgcagatgtgataaatagtaatattacttgcataaataacaatgctaatatgaatatcagcttagaaactgaaaaaggttcctgcgaaagtaatgtaactaatgcaaagtcaagtataccaatctctgcgaaaaagaagaatagtaagggcagaaaaaaatccaataataaaagcgacattaacgagataaatttaagtgacgatgatgaagaaatagttgaactttgttcaggagatgtgacgcttggaaaagatgaaaaagtagttatggcatttactatgtaggtattatctaatataaaattttctagataatcacacatataaaatatgcattattttctaaaaaggtatataatattaaaagtgaatttaatattgtttaatgttttatgagaaaaatttaatttatgtagggagagataataactatatgaataatgcacaagaattattagattttataaataatggtaagacggcttttcaaagtacttatgaaattaaaaatattttagataagcaaggttatacagaaattaaagaagaagataaatgggaattaaaaaaaggtagtaaacactatattataaaaaataactctgcattaattgcctttgaaatagggaatggtgatattgaaaaagatgggttcagattaataggagcacatactgattcaccaggatttagaataaagccaaatccagaaatgaaagttgaaggacattatgtgaaattaaatactgaagtatatggagggccaatactaagtacttggtttgatagacctttaagcgtagcaggaagagtaactttaaaaggagaaaatccattcagtccaagagttgaattattggatgtaaataagccaatcttaattattcctaacttagcaatacatatgaatagaagcgtgaatgagggctatgaatataataagcaaaaagatactttaccaatgcttacaatagttgaagataagctagaaaaggataattatttaattaatttaatagcagaaactttaaaggtagattctagcgatatattagatttcgatttgtttttatatgagtatgcagaaggtatgctaattggcttaaatgatgaatttatatcatgcggaagactagatgatttatggatggtatttgcaggattaaaagctttaataagcagtaatgaaattaaagcaacgaaggtattagtagctttagataatgaggaaataggaagcttaacatcccaaggtgcaaattcatcaattttagaaaatattttagagagaataactttgggtcttgaaaaagatagagaaagtttcaagagagcattaagcaactcaataatgatttcagcagacttagctcatgcaatacatccaaactatgttgaaaaatgtgatcctacaaataagcctatgcttggaaaagggcctgtacttaaaattgcagcaggtggaagttattcaactgatagttatgcaagtgctgtcttcaaaggaatctgtgaaaaagccgaagttccatgccaagtatttgtaaatagatcggatttaagagggggaacaaccattggacctattactgcatcaaaattaaatataccagtaatagatatgggtgcaccactactaagtatgcattcaataagagaattagctactgtaaaggataatgaatatacaattaaagcatttactgagttttttaattaatagattgtaatagtaattaacaatgggaaatgtctaagcatctattaaagtgaagactttttaataacttgttaattttaaagcatcagctaatatctaatgaacgtcaataaatagccattttaaggttgtctacatgataactttagatggctatttttttatagattatgaatataagaatactttttataattttggtaaaaatatctccgttgggtaattgttattaatgttaggtatatgaaagaaaataataatcgataatgcaaaatgttgtatttatctttagataaaaaaatatgatttccttatagcgaggtacttttgggaagttatgtttataaagtataaagataaatagactatcatattaacctattattttttttgaatataccaatagtaagaagggagttttttacttgaggagaaataattcttatggagtaagaaagaatgttttaaaagagttagctgatggattttcttgcatccatgaaaattttaggtactttagcaaattatctaagaacggatataaagtgcttggggcatctgaatggcttcttgataatatatacttaatagaaaaagagtacaaagcgataaagattgagatgcctatagattattttaagggactatcttctataggtaatgttaattacaacagaaataaagataacaatacagatgaagataatgaaaatagggaacttattccacgcatttttgtagtggcaaaggactatataaataacgggaatgagattgattgtgataaacttatatcatatataaacggacttcaaggcgatattgaaagcggaaattttaataataaagagaaaattttcactacaggagaattgtgggcattcccattaatgcttaaaatagctataataataaatttatctaagtatactaacgaacttgttgatattcaaaaagaaatcataagaggaagagatatagctgaaaagataatagatgcaattaataacaataagttcgaagaaaaaataggaaatattaatgttgggaagaatattggacctttatttttaagagaattttttagtgtattaagagataattctatagaagatccaagaataaatgatcttgtagagtctaaatggaaagtaaattcggatttagataaaaataatattagaagtgatttaagagaagaagttttagaaagaaatattggagaatacataacatttattagaaagattgagggaataagctggagaagattctttgaagaaacttcttttgttgaaaaaatacttaaaaatgatcctgcgaatatttatgatagcatggattttgaatctaaggattattataggcataagctcgaaaagatggctagaatatcaaacgcagacgaaattactttagctagcaatattttagagcttgcaagaaatagtaaaactaataaagaagaaaattataaatgccatattggatattacctaattgatgagggaataaacgaattaaagaaatatggaaataatataaaaacaactatatctgcaaatacgtatgtagcatgcaatatttttggaacactcttaataagttttcttattttattaataagcagtttattaggagttagatataccttagtacaatacgtaatttcgttccttataatattaattccagttaatgaaataataattggacttacgaattatactgtgggcaaagttgttgatattagattaattccaaaattaaattttagttcaggaattcctaaagaaaataaaactgtagttgtaataccggctatagtaaattctaaagagaaagttaaagaacttatgaaaaaattagaagtagcatattgcggaaataaagataagaatatttattttgctttgctaagtgattttcatgattctgagcatgagacttctccggaagatgttgagataattaaatcaggagttcaatatgctagagatttaaatgagaaatattccgatgactttaaaaatgatcaaggagttagtgaaaatagattctttttctttagtagaaagagaatttataataagaaagaaaatgtattcatgggcagagaaagaaaacgtggaaagttaatggaatttatggctcttattagagatggtaagaatcatacttataatgtttttagctcggatattcaagaactgaaacaagttaagtatctaattacattagatgaagatactttcatgcctagggaaagtgcttttaaacttgtaggggctatgagccatattcttaatattcctcatataaaaggcaatagagtcgcaagaggatatggaataatgcagcctaaggtgagcattagcctagaagctaagaatcaaacttatttttcaaaagtatttggaggagaagaaggagttgatggatattccgttgcttattctgacacttatcaagatttatttggagaagggtcctttactggtaaaggaataatatgtatagatgaattttataaagtgttaagtgattctataaaagatgatacagtcttaagtcatgatttgcttgagggtggtattgcaagatgtggattattaagtgatgtggaatttattgatggatatccagcattttatgaatctagctgcaaaagattgcatagatgggttagaggtgactggcagctaataggatggttattttctaataaaataaatttattatataagtggaagatatttgataatctaagaagaagtttattagcacctaatttacttctcgcccttatattatctctcactgttttatttggaagaagtcaagttgcacttcttgcctttttagctttaataactccattagtatttgtggtaacagattttgttgtaacacctaaaaataaattaatgggagcatttaaaacgctagagcagatagtgctaatagtaagctttattccttatcaagcttttttgatgcttgatgccataatagtaacactatatagagtaatgttttctaagaaaaatcttttagaatggcagtcagcagaacttgtagaaaaaaactcaaggaataattttattaattatttaaagagaatgtggattgctcctataatgggtctgcttgtactatacttatcattttatagttcgttaggagtagttacttatagtgtagtagttgcggcattatggatagttagcccttatatggcttataccataagtattaaacgtccagaacacaagaagaatactttaaagaatgaagaaaaaacttacttaagaaaaatttctagaagaatatatgcttattatgaggattttgttaatgaagaaaataattatctagctccagataactatcaggagaagccatttaagggagttgctcatagaacatctccaactaatataggtatggggattacttcaagcattgctgcatatgacttagggtatataaccatggcagagtttgttgatagaatagaactcatattaaatagcatgaaaactcttcaaaaggttaatggtcattatctaaattggtatgatacaaaaacaaaagaacctttatggcctagatatgtatcaacagttgatagtgggaatcttctaggtaacttatgggtactaaagaggtctatggaagagcttaaacataataaagttataagagtaaaagaagttacatctttgaatgatatttacaaaataattgaagatgaagcccctaatttaaagcttaaattttcttcacatattaatattggagaatatataaatgtattaaatgaaatttcctttaaacttcaagatttaaaggaaacagagcagataatcagtctaaagcagaaacttaagtcggaaaataataatatgaataatgaaaataacttaagtgatgaagaggaaaacagtataggcgaattaaaacttgagagtgaagaaacaagatattggattgataagcttataggtgaggttagaaaaaagattagctattataatttcatttttgaaggtatagaaaagttatatagtaaggaatttttcgaaggagtcccagatattgttgaattaatccacagatgcgagaattatagaagaaaaaatggggataatttcagaggcaaatttagagaaaagataaataatttcaaaaattacatagataaaatagataatataatacaagatattgataaaataacagaagaaatggattttacttttctttatgataaaactagaggactattctctatcggatataatgtagaggaaaattctcttggaaattcctattatgatttgcttgcatctgagtcaagaatagcatcttttgttgcgatagctaaaaatgatgtgccttcttcccattggtttaagctaggacgttccatgactaacgcattccatactcattcactagtatcttggagtggaactatgtttgagtattttatgccatcattaataatgaggaattatcctaagaccttacttagtcaaacttataagtctgtcataaaggcgcaaaaaagctttgcaaaacaaaagaagtctccttgggggatatcagaatctgcattttatgaatttgatgcggcagaaaattatcaatataaggcatttggagtgcctggacttggtcttaaaagaggacttgaagatgatcttgtaatatctccatattcaacattaatggctatttcttttgataaagattctggaattaaaaatcttaaagaacttgaaaagttaggcgcattaggaagatatggtttcatagaagctttagattatactaaagctaggaaagataagtacataatgacactttctaaaagtgatcttcttgagcagaatatttcaacaaatggaaaaaattatacacaaaatgtggataagtatgaggattatgtggataactacgaaaaaatagtggataatacacaggataaaaatacaagttatatgaataataagcatgttgataatgtgaataatgtggataagaatgatgaaatcagtaggattcacatgaataatgacgatgagcgtaattatgataactcaagttatccacagaaggtcaataaagttgcaacttatatggtacatcatttaggaatgtcacttatggctttggataatattctatgtaatgatattttgataaatagatttcatgatcttcctgagataaaatctacagaacttttactaaaagagaaaattccacaaaatgttgtctttgaaagaaatgaagatttttctgttaagaatagatattttgagggagaggttttaattccaagagtatttgaaaaagtgaatcaggatagtccacaagtattactattaagcaatggtgaatattcatctatgttaacagtaaacggaaatggatattcaaaaaagaatgatactatgctttatagatggaagggaaactctacaagtgatgatagtggaatgttcttctatataaagaacttaaattcaaatgaatattggagctcaacctttgaaccttgtaaagatcttggagataagtattcagttgagtttaatctagataaagcgaagtttagtagaaaagatggtaacattgaaacttcaatggaagtttcaatatcatcagaagaaaactttgaagttaggaaattaactttaaataacaaaggagataatggaagaagtattgaaataacaagttacatggaagtgactttagctacattcagtgctgacgtagttcacccaacattctctaatttatttgttcaaacagaatatgatgaaaaggaaagtgttcttataggaagcagaagaggtagagttaagaatgcaaaggttccatatattttccataaagcggttgttaatggagacttagaaggaagcatttcatatgaaacttcaagaataaattttataggaagaaatagagaattgaagaatccaaaagctatggataatgataaagctttagataatactgtgggaacagttttagatcctataatgagtataagaacaagaattagattagagcctaactctaagaaggagatttattatataactggaatatgtgaatcaaaagagcaaatacttgaaatatgcagaaataacaatgacaacagtaagctagagagagtattcaaaaattatagcataagtgcacaacttgaactaaagactttaggaataagaagtgccatagctaatatattccaaagctctgcaagctcaattttctttctaactaatactagaaaaaatagagaagaatatattaggaatatttcaagacatcaaaaggatttatgggcatatggaatctcaggagatttacctattataatgttagctatagaaaatgaagaagacataaatttagtatataccatggtaaaattccacaattacttaagaattaaggggttaagttagatttaattatatataataatgaagaagtttcttatgatgaaccacttcaaaaaaatataatggaagtaataaggtcatccaatgtaggtaattaccttaataaagcgggtggaatatttattcacaataaggcaaccatggacgctgaaattaaggatttactaataggaatttctagagtatatgtagataagaataatccattaagttcatatgcatataatgaaaagaattttaatagatatgtggacttagatgatgagggattagattcgcgtatagctttaagaaataattcaaggtttaaggataaatataaggatgaaaatactaaccaagatacagatggtgaaaacataccttatgaagtatatgataatgatgaagaggtaattaatattcatgatttaataaagaatattaatgagccagaagatcaagatgatattgaagatttagaaatagataagaaatctaatcaaagtaagaaggaaagagagttagtttataactcagaaatttcaagtttagttgatgtagatttggaggtatcaaaagattctaataattatggtaaagatgcggatgatgatcctgatgtaagtgatttagatttctttaatggttatggtggattttgtaagaacgataatagttatataataaaactatctaattacagaaatacaccagcaccttggattaatgttatttcaaatgatgacttcggattccatatatcagaagtaggatcaggatatacttggtgtggaaattctagagaaaataaaataacaccttggagtaatgattatattagagatcctataggagaagcattatatattaaagataatgactctggtaagtatttttcaataacaccaaaacctgtaagagattcaggtgattacttaataaaacatagctttggatactctgaatacagacatacagcatataatataaaaggaaaattagaaatttttgctcctaaaaatgaaagattaaaaattcagagggttacgctagaaaacttaagtaatgaggatagaagtgtttcgctattctactatgcaaaacttgttttgggtgtttatgagtatgatagttcaagatatatctcaacatatataggtggagatgaatcaaactacaaagaaacaatggacgtagtaaatagaagcagcattaaaaatagtaatgaagattttgcatttagaaataaatttataggtgctcataatccatacagtgaatactttggaaaattaaatgcttacttaaccattataggtgggaaagaattgagtttcactggagataataaagagtttttaggtattggaggagaaacctttagtcctgaggctctaaaacataatagattaagcaataagtctggtggcatctatgacccttgtttagcggcacaaacaagtattatgttaagaaaaggtgagaaaaaggaactgctaatcctatttggtcaagatgaaaaagaaaaaatagatgaattaataagtaaatataagatttttggaaatgcagaaaatgaattagataaagtaaaacaatattggagcaatttcctagggaatatacaagttaagacaccagataagtcattagattatcttttgaatggatggcttttatatcaaactttaagttgtagatatttaagcagaagtgcattttatcaaagtggtggtgcttatggattcagagatcagcttcaagattctatgtcacttgggtttgtaaatccagaaataacaaaggcacagatactaagaagtgcttcaagacagtatgtagaaggtgatgttcaacattggtggcatcctgttgttaattcgggaataagaactagatttagcgatgatttattatggcttccttatgtaacggccgaatatattaattctacaggagattacgaaattttaaatgctagtgctccgtacttagaagatgaacctttaagagaaggtgaagatgaaagatatacaatagtaaatcaatcatcaaaagaaggaactatatatgaacattgtttaaaagctatagaaaagagcttgaagtttggtattcataatattcctttaatgggtagtggagactggaatgatggaatgagtactgttggaaacgaaggaaaaggagaaagcgtatggcttggctggttcctatattcaatattagaaagttttattgaaattgcagataaacaaaacgataagcaaacaaaagaacattttgaagaaagaagagagtttatacgagataacctagagaaaaacgcttgggatggcggctggtatagaagagcatactttgatgatggtacacctcttggttcaagagaaaatccagaatgcagaattgactcgttagctcaaagctgggcaattatatcaggtgcaggacagaaggaacgtagtatcgaagcaatggaagcggtggataataaccttgtaaagaaagataagggaatgatcctattgcttgcaccaccatttagtaattctaagttagaaccaggttatataaaaggatatgtgcccggtgtaagagaaaatggaggtcaatatactcatgctgcagtttgggtgatacttgctttaactaaacttgggcttggtgataaagcggtaagctatttcaatatgataaatcctataaatcatgcaaaaacagagttagagtgtatgacatataaagtagaaccttatgtaatggcagcggacgtatatataaaagagcctcacgcaggaagaggtggctggagttggtatacaggagcttcaggatggatgtacagagttggcgttgaaaatatcttgggacttagaaaggttcaagacaagggatatgctataaatccatgtataccaaaagcttggaacgaatttgaaataaagattacaaatgaaaaagaagattacactataaaagtctctagagcaaataatgaaaatggattaaacgtaaatactaagaataatgagcaaaataataattatcaaagtgatgtaacatccataccttatagctcagaaaatagtgataatcaagttgttacaaaggtagttgtaaatggagaagtaatgaaagataacttaattccaagaaacagcggtaagttagaagtttttgtatacttaaaatgagtatatagataaaacgaatataatctatacttatgcgtatgctcaccgaaatgaataatatacttttgttccagtttctaggtaattgtgatgggtgattccaaggccataaagttgcaaagagccaagtgctagctaaagaacaagctttgaactagcacatttggaacaacttatagccaaagaatcgcttccataaaaattaccaatgaaacattccacaaaatatatcactcatttctggttggagtatatttcatagtctaagtatagtttatgattgtgttatctatagatatctaaatttaacaactaaatttaaacctgaaattttaatttttattaaagctaagttttcagtgatgatgacatataaatttaatttaaaagtcgcatatataatattgttaggaacttagagtaaattaatttaagctgtataagatgattttataattatcttatacggctttttggttttaagagaagtatatagattttgagttataaagcgaaattatttaaatgacttaagctgtatgaaaaattcaaagtgttaccatgaaattgttattacgtatccgcagtaaatctattcataaaattaagtctaagactaacttttctttagaattttattaaatatgtagtttattatataaaaaacattataaatgttgataatagctagtaatatgttataatttatcaataatgcatgaaaaataagcataacttgtaaaagaataagtatatttattgtaataaacataatttttatagtgtaaaaaataattctaaaactactacttattttataagaaatattgataaggggagaaaataaatgggattgattagaaaacaatatgaaaagacaatggacaagcaaacaaataataaagataaaaatagctctgtgaaaataaagagcataaaaagcgaactcctaatcacaatgttatcaatatccgttgtactgactcttggaattattttatgtgtaagcactattttatcgaaatattatgataatgaaataaatagtaagaatgaaatgttatctaagcttatatcaaaaaatgtttcttcttttatggatacggcatataaagtgacagaagatctggcatataattcagaagtaagagaaggaagtaaagatacaaaggaaaaagtacttaaagaaactaaagacagaaatccatattttgaattattatatatacaggatgaaaaaggaatgcagactgggagatcatcaggggatcttgctgacagatcagacagatggtggtttgcgcaagcaaaaagttctttatcatcattcgtatcaaagtcatattattcagtttcttctaagaatccagtaacttcaatatttgttcctttggttgaagataataagtttgttggagtaatggggtctgatattaatttagaaaaattgcaggaagtagtaagtgaatattcagatgaagcatcaggaagatattctttcataatagatggagagggtgttgttgttgcacatcctaataccgaagtgattgaagaattatataattataaaaaccaaactagaacaactggagttaaagagggaaatcctaaggaagagccgatagaagtatcagatggactaaaagaaatcatagctcagttaatggctggaaatgatggtagcattaaatataaagaaaatggtcaaaattactatgcatcttatacgaacataaaattagatgggaattcatttaattggtcagttataacagttcaaaaggaatctagtgcaaaggctattataaataacataacagaaatctcattaatcgcaggcttaataatattacttgcagcagctgcagtaatcatgtatgtgtcgaaaagaatttcaatgcctataatagaaatatcaaacttattatctatagcatcaactggtgattttacagtaaaatcttctactagagcgaaaaatgaaattaaattattaggtgaaagcttcaatgagatgatgagcaaggtttctgctttattaatcgaaacaaaagatttgactcatgatatgaaagagagttctgcaattttggctgaaaagtctcaggaaacaactaatgtggcaagagatataaatattacatcacaggaaatagcccaaggagcatctaatcaagctagcggagcagaagagagtgcaaggcttggagaggacatgaggggagaatttaatcagttagaggaaaagactaatctaatgattaatgaatcaatcaattcatctaaagcaattgcaaatggaattaacaaggttcaagatttaaaagaaaaggcacaaacaacaatttccattgtagaaaaaactcaaggaaatatagaaagcttaagtgataaatctaagaatatagaaaatatacttggagttttaaaggggattgcagagcagactcagttacttgcactaaatgcatctatagaagcggcaagagcaggggaagctggcaaaggttttgcagtagttgcaacagagattcaaaaattatcacaaaattcagcagtatcaactaaaaatatgcagagataattttaaatataaagcaagatatattaagcagtgtaagtgatatgaaaaaagtaaaagaagtatctatggatcaattcgtttcagtaaatgaagtgaatgaagcctttaataatattacacaggcgactgacacaataacaactgcaatagattatatgggaagctttgttgaagaaatgaatgacaaaaatgaacaagtagttaattcaataaataatattgcggcaatatcagaagaaacagcagcatgttcacaggaagtaacggcatcaattcaaactcaaacggaagctattttagaagtatcacaggaagtggaaaaactgaaagaaaaagctgagcgtttagaaatggaagttgataagtttaaaatttaataaattctcaatgtaaatagatatcatgttactattctggtagtaatattgatatttatttgctatatcacataaattattaataattacttgataaatagtaaaaactttttgtagaaactgtaaaaaatctgttgaaaatactaaagattgaatatagaataatatctgaaaaatgaaatgaaacccaaataaccattttgcaaggagtatacaaatgagtttatattataagttgaagcataatatagttgatgtgtttttcatatttttaggctgcatgattgcatcgttaggggtaaatctatttttagtacatgcaaaacttttaagtggtggtgccactggtattgcactgattttagagtacactcttaaagttccatctggagtagtaatcttaataattaatctaccactacttgtattgagttataaaaaactcgatagatcatttacgatttatacaacaatagggatgcttagtctttcagcttctctgcttataacaaaaccactttcacgcctaattgatatgaatggtgatttacttatcttttgtatatatggtggggttttatgtggtattggctatggaatggtatttttaagacatggttccacaggaggaacagatattataaccatgcttattagaaaaaaatattcgaattttaatataggaagtttgggattttctctaaacttgataatagttattataggagcattaatatttggtattccacaagcattgtatactcttatttctttgttcattcaaagtacagttcttgacagagtattaaaaggatttagcagtaaaaaacttcttcttattctaacaagaaaagaaaaagaaattattgattatgtaataaaagatcttaaccgtggagttacatctttgtttgctgaaggtgagtatactcatgataaaaagaaaatgctttactgtattgtaagctcacaccaaatggttgaactaaagagcattgtgcatcagatagatccaggagcttttataacaattattgatatatctgaagttagaggtaagggttttttgacaatttaaaataatataaaagtccaccataaaaatttaatttatggtggactttttggaaataagcactaaattaaaatgataaactttagtgcctgagtattatggggtacgaatattattcttaccaacagcgggaaatttattcaaaaacataataaattttttataatacttattactggattttttataagtatttataaaattattcatctccatctatttcataattatcgggagaaagcatatcttgtgtgtaatcaaattcttgattagctatattatttacaacaatagggtcaactgctggattaggcatatttataggaaaatctacaccagttgcactttcaacatcatctttgcttggatgataattagttctcatttttggcaagtaggaattagtaaagtcttttttactaccatctctcacatcggaagtatgagatactttcttttctttactcatataaaatcactcctaacttaattatttttattatatattttctaaaagatccaattcatcgaagttcatcttaaactatcaaatcttatcccaataattttactaataataaattatgttattttgggatcatatatagattgtaattggatttcttaggctttagtaggttttaaacgctcgcttagtaaaatctcaaatgtaaatttatcgttgaaatatataaactatgctaaagatttatagttttaataactatcatagctaagaacatttgataaataaattttacatttgggttagtgttgtaatatatttcttaagcttaagaatttcttttatgtgaatcagtatttttgttatcatttttattactagaattttttgattctggtgaaaaaatatagcttaggtctggagcaggaacatcttctggagttggaacatatggatatttacctttactcatataaaatcactcctaatctcactaaattatctcatcttaatttatttatattaaatcactatatttagactcatcagagtcgccgtcagcatttagatcaataagctctgtgtctagattagttctagatatatttgcattatttaagcttttagcatttctttcacctgaagcagtagtctttcctacattttcagaatcagaagcctttgattttggtgaactttctttactatactcttccattggataatcatcgccagggtttatactaaatggaatttttgattgactcataaaaatcactcctatcttttgcttaatattatttacaatataaatatagatttgaaataaattttgatttgttgtagataaagttatatccatgctatttatattagtgattttggtttgactggttcagggtgctccaatccattagcatcttcaatgcttttttcacttggagcatggtcagctttcgaatctggaagatacatactttttattttttttagttcagaatcatttgggtctgatggatgtgaatcagttaattcttcttcagaataatatttttcattttcattagatgacattttttctttactcattaataatcactcctaacttctcaaatattatgatttttatattcaaaagcatcttcatgattcatagaaacagatcctgttactggatgcggtttagaggatgttgaactcgttatatttttattagggccgtcagtcgaaaggggatttaaacttctagttggtgcaatgttatctcgtcctccttgcctattagaagattcaggccttgtaccagataacttctcaacatcataatctcctggagtaggattatatggtgttctttctttgctcattgtaatcactcctcacatattaatttttggaatttatttatagtacataatgtctaaaattttgagataactaaagtaaataaaacttagttatatcttattatctgaaaaaagagtcgtattaatgctagaaatatttagattttatataaaaaacatggtagaattatgttaagtgatttttttttgttatttttaaaaaattcactttataatggatgaggaggaattttatgaataaaaatataaaaagaataattgcgatcacagttgctgtcaatacaatttcaacaatttcacctacgacattaaatacatactttgtaggagcaaaacctgtttatgcgtcttcatattctccagacgatgaacaattaaagacattaaagataaaatctttagatggagaaactcttgatttacgtgatggatataatggagatacagtaaaattaagtgatgaaacagaatattatacaaagcttaccgatgatagtgatggaatcaaaataacggctgaagctgaggatgatgattatgtagttaagatttttacatctgatgcagaaaatgctacagcttatgatccaggagatgaaatcttacttggaaaaggtgatacaactttatatataagaacttataagtctaaatcagaatttaataaagtaaagaataatgtatcaaattgtaaagaagaatatacgctaaatgtaagaaagactaaagaaagttcttatgaggatgattctcaagattcgatatatttagataagattgatttaagcaaaggaaatatagatttcttaaaagggaaaacaagctatgatataaaagttgatgaaaatgttgatagtatgtggattaaagcaattcctgagagtaatagcgacagagtcagagtagatggatcgttagtagattctagcgataattataaagaaactgtatctttaaataaaggtaaaaatgagattaaaataaaagttacagatagtaaggataaccaaagaacatatacattaaatgttactagaggagacgattcagataacgaagatgatatatacttagataatataactttaagtgaaggcgatattgacttttctaaagatgataattcatacaacgttgatttagatgagtctgtaagtaaaataactataggtgcagagccagaagatagcgattattcagttacaattgatggagatgaagtaagatcaagtgatgattatgaaaaaaaagtatcattagataaaggggaaaatgtcataaaggtaaatgttgaagatgagttaaatgataaaaagagaacttatactttgactataaatagaggtaaggaaacagacgacagcaaggacaataatactgaggatacatcagataagaaatctcaatgggttcaaactaatgatggctggaagtattatgatgaaaatggaaaagtattaaaaagttcgtggctttatgataaagatcaaaaagtatactgttacttagataaagatggcctaagagttacaggctggcataaagataatgaaaaatggtacttgctagatagtaagggagcaatgcttacaggttggcaaaaagataatgaaaagtggtatttattaggatcagacggagcaatgcttacaggctggcataaagaaacagtagatgatcaaaataagaacactgatacatcaactaactcaggagataatgatactaaaaaagttgataattggtattatttaaatcaagatggatcaatgaggacaggctggctatcagatggtggaaagtggtacttctttaatgcagatggaacaatgcaaaaaggatggttaattgactataattcaaaatactatttaactgaagatggtagcatggcaactggaacaagaactattaatggaaaagagtataaattcaataatagtggagctttaatactttaggaaaatagtatgaacattaatttaattgtacatttaatttagtttttagattaagttactaataatgaaacaagaactcgctttattcttataagtgagttcttgttttatgaattaactgattatctaacccaaagataaaattaagttttcaattactaacatatatattgcaaaaataattcttcatcataagtctgaaaatgttgcaagaattttatagaataaattaaaaatgggagtaagtggttgccctcatagttgtgcagatagtgcatttaaggatataggattaataggaagcggaaaaggatggatgttctatgttggcggaaaaggtggagcaagaccaagaatagcagatagaatagcactttctgtatcagaagaaaaggtatatgatttaatagaaaaagttattgaagtatatagagaaaatgcaactaacagagaaagattaggcgattacatagatagagtaggattagatgagttcaaagaacaaataaatcttaatagttatctataaagtgaaaattttaatacagggctttatctgaatagaaaattttcaaattaatgaacaaatcaattagtctaaatttaatatatctaatagtgtaaaaaatcatgctaaataatagcatgattttttattatttcaagcacagcaggaatatctgcaggagcccatttcaaagaaagcagactttctggcttcagccataataaagctgcatgttcattagctttaggatagctatttattaattcgcagttagtagttatcaaatttacaataaaatcatcatattcatgtctattttcattatgtatattaatatatcgtactttacaatttaattcttcaaatatttctctttcaatagctttttttggagtttcgttaacctctattttaccacctgggaactcccaaagatttggcgatttcataataggagagcgtaaagcacataatatttctccgttatcattttttataattgcagctacaacattaatagttttcttcatcataacacctcaaaaaatattttataatatatgtattgtattttcaaataaacttataaaatttaaacattcttttaaataaaccttgttaacaatgagcatttttcaaagttttaattaaatatttttaaaaaggaacaaatgtttaaataaactgtttacctttttaaaaagttaggaaggtaaaaatgaaaaaagttaacaataaacaacattatggaatattattaataattatgttaaaatacaataaaatggtattttataactttaggaaaaatagggggataatatgaaaaaattaaaattaacaaaagtaatagctagtgctttggtagtagcttcggtattaatgctaaatccaataggtgcaaatgcagaatggaaacaagataaaaaaggctggtggtattcagaaggaaattcatgggctacaggctggagagtaattgatggaagtttatattattttgatacaaaaggctatatgttaggtagtacgccaaatgagtttggggataatgtcattaatagtagtggtcaatttcaaaatgtcacaatagaaggagcatgggctttttataaacaaactggtgtaataatggcttatttaggtaatgacagcaatgttgtaattccagataaaattgataatgttgcaataaaaagtataggaaataaagcattttatctaaataagaatataacaaatataacgattccaaatggtataacagccttaagaagatcagcgtttttcgggtgtacgggtttaacaagcataaacatttctgctagtgtacaaagtatagatggatatgcattatcaggatgcacaaacttaaaaaatatatctgtagatagcaacaatataacttttaagagcgttgatggagtattgtatagcaaaaatggaactaaattgttaaattatcctgttgggaaagttgacgaaaaatacgcaattccagatggtgtgacagatataggatggaatgcattttctggaggagtaaatttaaaaagcatagaaatacctagcactgtaacaagcataggaagtagtgcctttgatggatgtaagaatttaagcagcataactattcctgatggagttatagatataggaattggtactttttatggatgtacaaacttaagcagtataaaaattcctaatactgttataacaatagagcatagtgcatttcaaaactgcattaacttaacaaacatagttcttcctgacagtataactaaaatagaacaaggagcatttaatggatgtaaaaatactttgtttaatgtaaaaagtgagtcagtgaaacaacttttaattaaagctggtgtagattataataaaattgtagggaattcctaagattaaacagtaagtagtaaattagtaattttataagctgagattttcttatatatattgcaaaaataattcttaatgataattttaaaaatattgcaagaattttagccgcaattgtgaaatgtgcattgtgaatcgcaatatatatatttagaaagtctcagctttaataaataatatttcttagaagaatttgctgatattatagcttatttcatactagttttattatttcttaggtcaaatttttcaattttctctggacctcttaatatttttctttttatatgaagaataccctctgaatcagttctgattctccattcaataagcataatttttccatctactatttcaattccttggattccacttgccctaacacatgatccatcattgaagtaaggtaattccttgacttttggaaagtggggcctatgagtatgtccgcagatgatcatgattttgttcattttaatccaatgactataaatacgctcgattttatgaatccgttcagaactctttacggggcttgcaggatttatgaatcctattgagtgaagaaatttccaaaagtatcttactgtaagcatattaaaacgccacaaattatcattcattctgtctccttgatgaccatgaacagttagtatttcctgacctgtgtttttatgtttaaacacgactgcctcatatggtgtaataccaggaaacaactctatttcttcttcgttatattcatcatagaatttataataattcttttctacataattgctatattttaagtgtacattgtgattaccatataacataatcaatctatcagaatcaaagaacttttttaatagagcatatacttcatcatgtgcaagtcttatatgtttaaagttagagtgttcccaaagttcatctccatcgccaacttcaacataagtatacccattattaagataaaattctaatgcaaataaaaaaatattttgattttttgcaaattcatcagagggtgtaccatcacctctatggcaatcactgaaaaatatgtatttagagttgttatcaaaatattcaattttagcattcttataagcttctgttaatcgcttttctgcgagctttttttccgctatcatagtacacctcttttatgatatttaaaattaatttaattatatgtagttaatctgcccctttaaagaagaatatatgttagtcagataccattttttatcgtgcttaaagcaatttaatcaatgattctaactcttcagataaggcttttgcacgttcaaaatcagtatttcttagggagatggctattttaatttctaaatctcttttcttttgttcaatttctaaatagtctttatcaaagtatttcgcataaatcatctttctaaattttctcatattcatttttctgattgttttatcttcaataagtaaaacataatctacgcaattaattatggaatagtaatcatgagatatcattaaaatagcaccattgtatttttctatagcttcttcaagggccatttgtgaatatatatctaaatggcttgttggttcatctaaaagcagcatatttgctttgcttgcagaaattttggctaattgaagtatattcttttcaccaccagataaatcttttattttttggttgattctttcttcttcaaaatcatagtttgaaatgtaagtttcaacatcatcataagttttaaatcctgcgtctaagaattcttcaagtattgtattagactcatttaatatttcgccttgaagctgtgataaatatgcaacttcaatttcagaatctatttcaatagcagggttgtcatttttaaagatatctctaagtaaagtagtttttccagtaccatttaacccaacaatagctactttatcattagatttaatctcaaaattaacattttctaaaagtatttcatcaaagccagcactataattattaacttttaaagcaactttttcttcaacttgattgttagtagttaaacggatataaggctgcttaatttcaacaaaaggtctttttatctacgagcttctaatctttctaggaatttcattttaccttttagataccttccagcagcagtttcccctgtaacttcagctctatctcttagtcgctttattattcgttcatttctctcaatttcttcatcatcagcaacagatagttcttgaagttcaatcttagtttgaagtaatgtgaagttatagtctatataacttccatcaaattcttggagttcatgattttctagatgaataattttattaaaacaattatttaatagatatctattgtgagtaataactagcatcattcccttatgagaatttattaggtttttaagagaattaagattttcaaagtctaaaaatacatcaggttcatccataatcattaagtctggactattaagcatttccctaattacttggataagtttaaactctccaccacttaaatcagatatctttgaatccttaagtttacttaggtttgcaagatttaatttcttactaagagtgctttcaaaatcatctccaccgattacatcaagagcatctaaagcttcctgatatttttctagtagggcatcaatatcagaagaggtttccattaagctgcaaatagaagttatctcattttgtagtttaatataatcttcacatagatattcgaaaactgttgtttcttttgtgttatctacctcacagaactgactcacatatccaatcctgcaatttggatcaatctctagagtaccatcaaacatatagttctctggatccatgattatatctattagtgtactttttccactaccactagaacctataaaagcacaatgctgatcattttctaaagtaaatgaaatattatgatatagatccttatttggaaatgagtacgacaagttatcaatttttatcattttattacctcgtttttcatatgattaaattttataatcatttatattatgttatatatcgtataattttacacttgattgtatcatagattcggaagtttataaacatttgtgaaagatatattgtatgatattctcttaaaggaacattgttttaaataaaacattttcacaatttaaaaagttaagaatttaagaaggtaagaataaaaaaagttaacaatttataggaaacataatgggtgagacatattaaatggttttgaagatacaaatagtatgaaacttgtgatattgttaaataatttttataaaagctgagatttgtaccattggaaaaatctcagcttttatatataatacaagaaatcactatttcttggggtcaatatatttatgttatattgaaatgcaaaatatggaataatagaattgttgatgatataaactatattttaagttaaggcatatttaattacttttcattactatcattaatagagtcagctagcaaattttcaatctgctgcataaagtttataatatcgcagatgatagttgaccttgtgctcattcttaaatttaatgtatctaatttattacccaatgaattcacaatctcagtgacagagtcaacaccagttactgcaccgctaatctcagagcttgtacgctcaattcctttaattatatgctggctaaactcttttgcttcaatagtacaatcagttacttgtttgaaatctttttgaacattttgagcatattcatagttatcagtaattgctgttttagaatttctaatttcctctctaagagaatctatgctttcatataattctttaacacttttatcaattccactaactaattctgttgttgataaggataattttctaatttcatctgctacaacagaaaaacctatacctgcttcaccagctcttgccgcttcaatagatgcatttaaagctaggagatttgtattgctagctatgcctgttatactatttgacatattttgaatgtttctagagttattttctaatttgtgaaaggcctctgtaattgaatctagctgagtgcatgttccattaattttatctgccaacgtacccattttattatctgcttgttttactgaactgtcagaacgattcataacatcattaattttattagcatattggctaaaatcattaaaattagagtctatattgttaattacattttgtatggcattgatttttgaatatgtattgtcgatttccttaatggattgagtaactctaacttcttcatccatgaattctccaaatttcttttccatatgtaaaatgccataattaacatatttatcataattggattcttttttatatctaatttaatattttgtccattttgaatattttcttcttcgtttttatctttcttttttctaaatttaaaaaacttcatatcgtattacctcattctattcaaatacagcaagaaccattgtctgattaaagtgttgatctctaagctgttctccataacctgcaaaacctatatagttacctaaagcattgcccatatttttagcaaactcatttaaatacccatctgtttcgaaaagcattgatcttgccagacagttaaccataatagctaatgatggatttggaacttcttttttcactgtagcaattgtttcattatttacattcttataatcatcaggctctaagagaaccatttttgaattattatatactttcgcatggtatgacatcccattatttttagtaactatttggtttgctgtaatatacagatcacttccgataattctacctaaaggataactatctaaatattttggaagattttcaacagtggtgtttaatgcttgagccataacaagtgctgctggtttattatcatattcatgtactatacgatttcttgtatctactttagtggcagtaaaataatgagcagtttttttataaatattttctctgtataatctgattttaccacttaaatttttgatgattacaaaagcacatgtattgttgtgtactatgccgttaaaagaaaccattgttttttcagccttacctttgtcaccagcagatccgccaaataggggaatcttatgttcgtcaaggactgaatttaatgtagataaaactagttcttcacagcttattaaagcagtagaaatttcaaagcatatggtattagatttatcacgaaaattattaacacatttagtcactctatctatgtatttaagaggatatttatctacctcttctaatatatcggcataacattcaattccatcctcaatacccattaccatcagtgaatctttataagctccatccatgcaaaagcctgcaaatgtggtggagccaataataatactgttttgaaatttttctttcattttcttagtatattcttcaaaaggttcaacattggaaaaaaataaaattaatttaggtgctttaagcccaagggtagcttctgatactgcttcatttaaatcactttttgaactttttcctactttataattcatacgtaccaccttctataataaagtgcataacattagattcaataaattttttattatgcaaaattactcaatatatccataaatttgtctatttattgataattgtacgtactacataaataaaagtcaatgaaaatattggattatttacattattttaacccgtagcgttgtaagtacagcttcctattgtaatgaatcataaggaaagaattatctgaacaatatggtaaacaagtatggtactaaggaagaagcagctgatgaacttataacaataattatacaaagcgaaaaaaatattgaatattaagaaaaaactgaaaatatttttgaaattacaattattctcataatagttattgacaattgtgtaacataccgtataatagatttatacacaatggctggtgttaataacaccagctattttttttacaataattttaacgttaaaaaattatcttacaataattctttggaatatattcaaaatagaaaagtaaatattattatgcataatatggtgaaaacaataaaataggattaaaaatattaactatatgacaaaggcgtctataaaatcaaggaagattttataggcgctttttttgtataaaacaggactagtattaaataaaaaaattgaaaatttggaggagatatttatgattaaaaagacatttttcaaaagaatattgggggtagtaactgtattagcaatgacagcaacaatgtttatggggtgtagtgagacagctaaagtaagttcaaatgggggaagtgcagctagtggagatacaattaagatcggaggagtatttccattaactggtgatgttccagctttgggtgcagcaatggaaaacggatctaaacttgcaataaaagaaataaatgatgctggtggagttcttggtaaaaagttagagcttgtttcagaagacgatcaaaatcaagcagcaacagcgccaaatgccattacaaagttaattacgcaagataaagtttcggcagtagtcggaacatatgcaagtaaatgttcaattccaatggcagcagttgcaaaagattcaaaagtagttatgattactccggggtcaacaaatgagaaagttactactgaaggtggagattatgtatttagagcatgttttatagatccattacaaggtcaagttggtgcaaaattcgcgtcagaaaatttaaaagctaaaaaagtagcaatgctttatgatattggtaatgattattgtgtaggtatttcaaaagaatttaagaaaaactttgaagcggcaggggggactgtagcatatgaaaaaacttacaatgcaggagaaagtgatttcaaagcatttttaactgaaataaaagaattaaatgtggatgtaatttatcttccagataactactcaactgttggattaattgcaaaacaagcaagagaaattggtataaaggcaccattcttaggtagtgattcatggagtgatccaggtcttgtaaaagttggaggagatgcaattgaaggatcttactttacagatcacttatcgttaaaatcagataatgcatcaattaaaaagttcgttgaaaattacaaaaaagaatataatggtgatcctagtgcattctcagtacttagttatgattcagtatacattttagcagaagcaattaaaaaagcaggcagcacagatgaaaatgctattaaagatgcaatggctaagttagatgcagattgtggaaccacacattataaattcgatgataaacataacccaattaagagtgtagttattaataaagttgtaaaaggacaatttgaatttgaaactgaggttaaataattctaaagaaaattaaattttattgtttagcggctatattaatggggtaagctgtaatttaagtagacctagagatatagccttttataaaggagaggtgtacatgagtactttattacaacaaattgtaaatggtatatgcctaggtagtgtatatgcattaatagctattggctacactatggtatatggaattattaaattaattaattttgctcactgtgatatttatatggttggtgctttcttaggttactttgc
